US011241485B2

(12) United States Patent
Suri et al.

(10) Patent No.: US 11,241,485 B2
(45) Date of Patent: Feb. 8, 2022

(54) PDE5 COMPOSITIONS AND METHODS FOR IMMUNOTHERAPY

(71) Applicant: Obsidian Therapeutics, Inc., Cambridge, MA (US)

(72) Inventors: Vipin Suri, Belmont, MA (US); Byron Delabarre, Arlington, MA (US); Michael N. Gladstone, Cambridge, MA (US); Celeste Richardson, Brookline, MA (US); Brian Dolinski, Cambridge, MA (US); Abhishek Kulkarni, Brookline, MA (US); Mara Christine Inniss, Beverly, MA (US); Dexue Sun, Cambridge, MA (US); Dan Jun Li, Cambridge, MA (US); Grace Y. Olinger, Cambridge, MA (US); Scott Francis Heller, Stoughton, MA (US)

(73) Assignee: OBSIDIAN THERAPEUTICS, INC., Cambridge, MA (US)

( * ) Notice: Subject to any disclaimer, the term of this patent is extended or adjusted under 35 U.S.C. 154(b) by 0 days.

(21) Appl. No.: 16/621,593

(22) PCT Filed: Jun. 12, 2018

(86) PCT No.: PCT/US2018/037005
§ 371 (c)(1),
(2) Date: Dec. 11, 2019

(87) PCT Pub. No.: WO2018/231759
PCT Pub. Date: Dec. 20, 2018

(65) Prior Publication Data
US 2020/0101142 A1 Apr. 2, 2020

Related U.S. Application Data

(60) Provisional application No. 62/518,078, filed on Jun. 12, 2017, provisional application No. 62/523,850, filed on Jun. 23, 2017, provisional application No. 62/523,862, filed on Jun. 23, 2017, provisional application No. 62/555,313, filed on Sep. 7, 2017.

(51) Int. Cl.
| | |
|---|---|
| *A61K 38/46* | (2006.01) |
| *A61P 35/00* | (2006.01) |
| *A61K 31/4985* | (2006.01) |
| *A61K 35/17* | (2015.01) |
| *A61K 38/17* | (2006.01) |
| *A61K 38/20* | (2006.01) |
| *A61K 39/395* | (2006.01) |
| *C07K 14/54* | (2006.01) |
| *C07K 14/725* | (2006.01) |
| *C07K 14/705* | (2006.01) |
| *C07K 14/715* | (2006.01) |
| *C07K 16/28* | (2006.01) |
| *C12N 9/16* | (2006.01) |
| *A61K 39/00* | (2006.01) |
| *A61P 37/04* | (2006.01) |
| *C07K 19/00* | (2006.01) |

(52) U.S. Cl.
CPC ........ *A61K 38/465* (2013.01); *A61K 31/4985* (2013.01); *A61K 35/17* (2013.01); *A61K 38/177* (2013.01); *A61K 38/1774* (2013.01); *A61K 38/1793* (2013.01); *A61K 38/2086* (2013.01); *A61K 39/3955* (2013.01); *A61P 35/00* (2018.01); *C07K 14/5443* (2013.01); *C07K 14/7051* (2013.01); *C07K 14/70517* (2013.01); *C07K 14/70578* (2013.01); *C07K 14/7155* (2013.01); *C07K 16/2803* (2013.01); *C12N 9/16* (2013.01); *C12Y 301/04035* (2013.01); *A61K 2039/505* (2013.01); *C07K 2317/53* (2013.01); *C07K 2317/622* (2013.01); *C07K 2319/02* (2013.01); *C07K 2319/03* (2013.01); *C07K 2319/30* (2013.01); *C07K 2319/33* (2013.01)

(58) Field of Classification Search
None
See application file for complete search history.

(56) References Cited

U.S. PATENT DOCUMENTS

| | | | |
|---|---|---|---|
| 8,173,792 B2 | 5/2012 | Wandless et al. | |
| 8,530,636 B2 | 9/2013 | Wandless et al. | |
| 9,487,787 B2 | 11/2016 | Wandless et al. | |
| 10,137,180 B2 | 11/2018 | Wandless et al. | |
| 2002/0100068 A1 | 7/2002 | Chambon et al. | |
| 2004/0038373 A1 | 2/2004 | Platz et al. | |
| 2005/0048573 A1 | 3/2005 | Artis et al. | |
| 2009/0087871 A1 | 4/2009 | Kanacher et al. | |
| 2009/0215169 A1 | 8/2009 | Wandless et al. | |
| 2010/0034777 A1 | 2/2010 | Wandless et al. | |
| 2012/0076732 A1 | 3/2012 | Feng et al. | |
| 2014/0255361 A1 | 9/2014 | Wandless et al. | |
| 2014/0271635 A1 | 9/2014 | Brogdon et al. | |
| 2016/0145337 A1 | 5/2016 | Galetto et al. | |
| 2017/0157176 A1 | 6/2017 | Wang et al. | |

FOREIGN PATENT DOCUMENTS

| | | |
|---|---|---|
| WO | 2000023091 A2 | 4/2000 |
| WO | 2007142929 A2 | 12/2007 |

(Continued)

OTHER PUBLICATIONS

Turko et al. Potential Roles of Conserved Amino Acids in the Catalytic Domain of the cGMP-binding cGMP-specific Phosphodiesterase (PDE5), J Biol Chem, Mar. 13, 1998, vol. 273, No. 11, pp. 6460-6466 especially, Abstract.

(Continued)

*Primary Examiner* — Suzanne M Noakes
(74) *Attorney, Agent, or Firm* — Kilpatrick Townsend & Stockton LLP

(57) ABSTRACT

The present invention relates to compositions and methods for the regulated and controlled expression of proteins. Methods for inducing anti-cancer immune responses in a subject are also provided.

26 Claims, 29 Drawing Sheets
Specification includes a Sequence Listing.

(56) References Cited

FOREIGN PATENT DOCUMENTS

| WO | 2016210293 | A1 | 12/2016 |
| WO | 2017024318 | A1 | 2/2017 |
| WO | 2017180587 | A2 | 10/2017 |
| WO | 2017210617 | A2 | 12/2017 |
| WO | 2018160993 | A1 | 9/2018 |
| WO | 2018161017 | A1 | 9/2018 |
| WO | 2018161026 | A1 | 9/2018 |
| WO | 2018161038 | A1 | 9/2018 |
| WO | 2018231759 | A1 | 12/2018 |
| WO | 2018237323 | A1 | 12/2018 |

OTHER PUBLICATIONS

Anguille S. et al., "Interleukin-15 Dendritic Cells Harness NK Cell Cytotoxic Effector Function in a Contact- and IL-15-Dependent Manner," PLoS One, May 7, 2015, Vo. 10, No. 5, e0123340, eCollection 2015.

Dolinski, B., et al., "Enhancing Adoptive Cell Therapies Through Exogenous Regulation", Poster presented at: Keystone Symposium: Emerging Cellular Therapies: T Cells and Beyond (joint meeting with Lymphocytes and their Roles in Cancer); Feb. 11-15, 2018; Keystone, CO, 1 page.

Dolinski, B., et al., "Enhancing Adoptive Cell Therapies Through Exogenous Regulation", Poster presented at: AACR Annual Meeting 2018; Apr. 14-18, 2018; Chicago, IL, 1 page.

"FKBP1A protein [*Homo sapiens*], National Center for Biotechnology Information, Sequence Accession AAI19733. Oct. 4, 2006 [retrieved on Apr. 18, 2018]. Retrieved from the Internet: < https://www.ncbi.nlm.nih.gov/protein/AAI19733>Genbank Supplement pp. 1-2".

Foa, R. et al., "IL2 treatment for cancer: from biology to gene therapy," British J. Cancer, Dec. 1992, vol. 66, No. 6, pp. 992-998.

Juillerat, A. et al., "Design of chimeric antigen receptors with integrated controllable transient functions," Scientific Reports, Jan. 11, 2016, vol. 6, p. 18950.

Kaufman, H. et al., "Brief Report: Local delivery of vaccinia virus expressing multiple costimulatory molecules for the treatment of established tumors," Human Gene Therapy, 2006, vol. 17, No. 2, pp. 239-244.

Reardon, C. et al., "Dose-Dependent Exogenous Regulation of Membrane Bound Interleukin 15-Interleukin 15 Receptor Alpha Fusion Protein for Adoptive T-Cell Therapy", Poster Presented at: ASGCT 21st Annual Meeting 2018; May 16-19, 2018; Chicago, IL, 1 page.

Shamah, S. "Development of a novel system for exogenous regulation of adoptive cell therapy", Oral presentation presented at: CAR-TCR Summit. Sep. 5-8, 2017; Boston, MA, 22 pages.

Sun, D. et al., "Exogenous In Vitro and In Vivo Regulation of Interleukin-12 Secretion From T Cells Using Destabilizing Domain Technology", Poster Presented at: ASGCT 21st Annual Meeting 2018; May 16-19, 2018; Chicago, IL, 1 page.

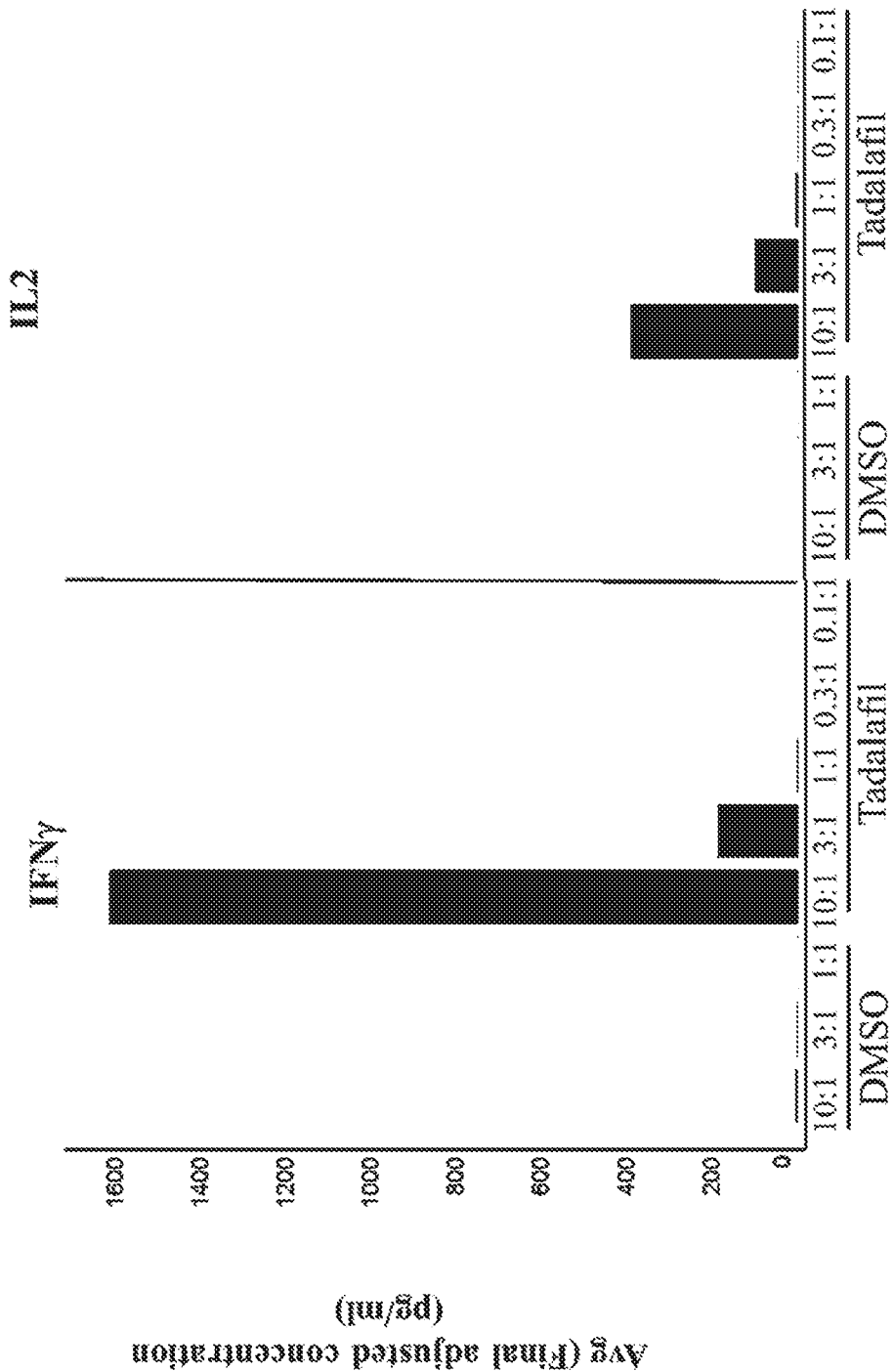

PDE5 COMPOSITIONS AND METHODS FOR IMMUNOTHERAPY

CROSS REFERENCE TO RELATED APPLICATIONS

This application claims priority to PCT International Application No. PCT/US2018/037005, filed Jun. 12, 2018, which claims the benefit of priority to U.S. Provisional Application No. 62/518,078 filed Jun. 12, 2017, U.S. Provisional Application No. 62/523,850, filed Jun. 23, 2017, U.S. Provisional Application No. 62/523,862, filed Jun. 23, 2017, and U.S. Provisional Application No. 62/555,313, filed Sep. 7, 2017. The entire contents of the aforementioned applications are incorporated herein in their entireties.

REFERENCE TO SEQUENCE LISTING

The present application is being filed along with a Sequence Listing in electronic format. The Sequence Listing is provided as a file entitled 2095_1003PCT_SL.txt, created on Jun. 12, 2018, which is 18,074,972 bytes in size. The information in the electronic format of the sequence listing is incorporated herein by reference in its entirety.

FIELD OF THE INVENTION

The present invention relates to tunable biocircuit systems for the development of controlled and/or regulated therapeutic systems. In particular, regulatable biocircuits containing destabilizing domains (DD) derived from mutant human cGMP-specific phosphodiesterase type 5 (PDE5) are disclosed. The present invention also relates to compositions and methods for immunotherapy.

Provided in the present invention include polypeptides of biocircuit systems, effector modules, stimulus response elements (SREs) and immunotherapeutic agents, polynucleotides encoding the same, vectors and cells containing the polypeptides and/or polynucleotides for use in cancer immunotherapy. In one embodiment, the compositions comprise destabilizing domains (DDs) which tune protein stability.

BACKGROUND OF THE INVENTION

Safe and effective gene therapy requires tightly regulated expression of a therapeutic transgenic product (e.g., the protein product). Similarly, the analysis of gene function in development, cell differentiation and other physiological activities requires the controllable expression of a protein under investigation. However, current technologies do not allow titration of levels of target protein induced or kinetics of induction. Inadequate exogenous and/or endogenous gene control is a critical issue in numerous settings including ex vivo and in vivo gene therapy. This lack of tunability also makes it difficult to safely express proteins with narrow or uncertain therapeutic windows or those requiring more titrated, controlled or transient expression.

One approach to regulated protein expression or function is the use of Destabilizing Domains (DDs). Destabilizing domains are small protein domains that can be appended to a payload such as a protein of interest (POI). DDs render the attached protein of interest (POI) unstable in the absence of a DD-binding ligand such that the protein is rapidly degraded by the ubiquitin-proteasome system of the cell (Stankunas, K., et al., (2003). Mol. Cell 12, 1615-1624; Banaszynski, L. A., et al., (2006) Cell; 126(5): 995-1004; reviewed in Banaszynski, L. A., and Wandless, T. J. (2006) Chem. Biol. 13, 11-21; Iwamoto, M., et al. (2010). Chem Biol. 17(9):981-8; Egeler, E. L. et al. (2011). J Biol Chem. 286(36):31328-36; and Rakhit R, Navarro R, Wandless T J (2014) Chem Biol. September 18; 21(9):1238-52; Navarro, R. et al. (2016) ACS Chem Biol. 11(8): 2101-2104). In some cases, the protein of interest is not completely processed and may not be secreted or presented on the membrane in the absence of DD-binding ligand (Sellmeyer et al., (2012), doi.org/10.1371/journal.pone.0043297; the contents of which are incorporated by reference in their entirety). However, when a specific small molecule ligand binds its intended DD as a ligand binding partner, the instability is reversed and protein function is restored or, in some cases, processing is restored and the protein of interest is presented on the membrane or secreted. Such a system is herein referred to as a biocircuit, with the canonical DD-containing biocircuit described above being the prototypical model biocircuit It is believed that improvements of biocircuits, including those containing DDs can form the basis of a new class of cell and gene therapies that employ tunable and temporal control of gene expression and function. Such novel moieties are described by the present inventors as stimulus response elements (SREs) which act in the context of an effector module to complete a biocircuit arising from a stimulus and ultimately producing a signal or outcome. When properly formatted with a polypeptide payload, and when activated by a particular stimulus, e.g., a small molecule, biocircuit systems can be used to regulate transgene and/or protein levels either up or down by perpetuating a stabilizing signal or destabilizing signal. This approach has many advantages over existing methods of regulating protein function and/or expression, which are currently focused on top level transcriptional regulation via inducible promoters.

The present invention provides novel protein domains, in particular, destabilizing domains (DDs) derived from mutant human cGMP-specific phosphodiesterase type 5 (PDE5), particularly the catalytic domain of human PDE5, that display small molecule dependent stability, and the biocircuit systems and effector modules comprising such DDs. Methods for tuning transgene functions using the same are also provided.

Cancer immunotherapy aims to eradicate cancer cells by rejuvenating the tumoricidal functions of tumor-reactive immune cells, predominantly T cells. Strategies of cancer immunotherapy including the recent development of checkpoint blockade, adoptive cell transfer (ACT) and cancer vaccines which can increase the anti-tumor immune effector cells have produced remarkable results in several tumors.

The impact of host anti-tumor immunity and cancer immunotherapy is impeded by three major hurdles: 1) low number of tumor antigen-specific T cells due to clonal deletion; 2) poor activation of innate immune cells and accumulation of tolerogenic antigen-presenting cells in the tumor microenvironment; and 3) formation of an immunosuppressive tumor microenvironment. Particularly, in solid tumors the therapeutic efficacy of immunotherapeutic regimens remains unsatisfactory due to lack of an effective an anti-tumor response in the immunosuppressive tumor microenvironment. Tumor cells often induce immune tolerance or suppression and such tolerance is acquired because even truly foreign tumor antigens will become tolerated. Such tolerance is also active and dominant because cancer vaccines and adoptive transfer of pre-activated immune effector cells (e.g., T cells), are subject to suppression by inhibitory factors in the tumor microenvironment (TME).

In addition, administration of engineered T cells could result in on/off target toxicities as well as a cytokine release syndrome (reviewed by Tey *Clin. Transl. Immunol.*, 2014, 3: e17 10.1038).

Development of a tunable switch that can turn on or off the transgenic immunotherapeutic agent expression is needed in case of adverse events. For example, adoptive cell therapies may have a very long and an indefinite half-life. Since toxicity can be progressive, a safety switch is desired to eliminate the infused cells. Systems and methods that can tune the transgenic protein level and expression window with high flexibility can enhance therapeutic benefit, and reduce potential side effects.

In an effort to develop regulatable therapeutic agents for disease therapy, in particular cancer immunotherapy, the present invention provides biocircuit systems to control the expression of immunotherapeutic agents. The biocircuit system comprises a stimulus and at least one effector module that responds to the stimulus. The effector module may include a stimulus response element (SRE) that binds and is responsive to a stimulus and an immunotherapeutic agent operably linked to the SRE. In one example, a SRE is a destabilizing domain (DD) which is destabilized in the absence of its specific ligand and can be stabilized by binding to its specific ligand.

SUMMARY OF THE INVENTION

The present invention provides compositions and methods for immunotherapy. The compositions relate to tunable systems and agents that induce anti-cancer immune responses in a cell or in a subject. The tunable system and agent may be a biocircuit system comprising at least one effector module that is responsive to at least one stimulus. The biocircuit system may be, but is not limited to, a destabilizing domain (DD) biocircuit system, a dimerization biocircuit system, a receptor biocircuit system, and a cell biocircuit system. These systems are further taught in co-owned U.S. Provisional Patent Application No. 62/320,864 filed Apr. 11, 2016, 62/466,596 filed Mar. 3, 2017 and the International Publication WO2017/180587 (the contents of each of which are herein incorporated by reference in their entirety).

The present invention provides compositions for an inducing immune response in a cell or subject. In some embodiments, the composition may include a stimulus response element (SRE) and at least one payload. In some embodiments, the payload may be attached, appended or associated with the SRE. The SRE may comprise a destabilizing domain (DD). In some embodiments, the DD may comprise, in whole or in part, the cGMP-specific 3', 5'-cyclic phosphodiesterase (hPDE5; SEQ ID NO.1). In some embodiments, the payload may be appended to the SRE.

In some embodiments, the DD may comprise the catalytic domain of hPDE5 (SEQ ID NO. 3). In some aspects, the catalytic domain may include amino acids 535-860 of hPDE5 (SEQ ID NO. 1). In some embodiments, the DD may include a mutation in the amino acid at position 732 (R732) of SEQ ID NO. 1. The mutation at position R732 may include but is not limited to R732L, R732A, R732G, R732V, R732I, R732P, R732F, R732W, R732Y, R732H, R732S, R732T, R732D, R732E, R732Q, R732N, R732M, R732C, and R732K.

In some aspects, the DD may be selected from the group including but not limited to hPDE5 (Amino acid 535-860 of WT, R732L) (SEQ ID NO. 12); hPDE5 (Amino acid 535-860 of WT, R732A) (SEQ ID NO. 384); hPDE5 (Amino acid 535-860 of WT, R732G) (SEQ ID NO. 383); hPDE5 (Amino acid 535-860 of WT, R732V) (SEQ ID NO. 385); hPDE5 (Amino acid 535-860 of WT, R732I) (SEQ ID NO. 386); hPDE5 (Amino acid 535-860 of WT, R732P) (SEQ ID NO. 387); hPDE5 (Amino acid 535-860 of WT, R732F) (SEQ ID NO. 388); hPDE5 (Amino acid 535-860 of WT, R732W) (SEQ ID NO. 389); hPDE5 (Amino acid 535-860 of WT, R732Y) (SEQ ID NO. 390); hPDE5 (Amino acid 535-860 of WT, R732H) (SEQ ID NO. 391); hPDE5 (Amino acid 535-860 of WT, R732S) (SEQ ID NO. 392); hPDE5 (Amino acid 535-860 of WT, R732T) (SEQ ID NO. 393); hPDE5 (Amino acid 535-860 of WT, R732D) (SEQ ID NO. 394); hPDE5 (Amino acid 535-860 of WT, R732E) (SEQ ID NO. 395); hPDE5 (Amino acid 535-860 of WT, R732Q) (SEQ ID NO. 396); hPDE5 (Amino acid 535-860 of WT, R732N) (SEQ ID NO. 397); hPDE5 (Amino acid 535-860 of WT, R732M) (SEQ ID NO. 398); hPDE5 (Amino acid 535-860 of WT, R732C) (SEQ ID NO. 399); and hPDE5 (Amino acid 535-860 of WT, R732K) (SEQ ID NO. 400).

In some embodiments, the mutation in the amino acid at position R732 may be R732L. In one embodiment, the DD may comprise the amino acid sequence of SEQ ID NO. 12. In some embodiments, the mutation in the amino acid at position R732 may be R732A. In one embodiment, the DD may comprise the amino acid sequence of SEQ ID NO. 384. In some embodiments, the mutation in the amino acid at position R732 may be R732G. In one embodiment, the DD may comprise the amino acid sequence of SEQ ID NO. 383.

The DDs of the present invention may further comprise one or more mutations independently selected from the group consisting of H653A, F736A, D764A, D764N, Y612F, Y612W, Y612A, W853F, I821A, Y829A, F787A, D656L, Y728L, M625I, E535D, E536G, Q541R, K555R, F559L, F561L, F564L, F564S, K591E, N587S, K604E, K608E, N609H, K630R, K633E, N636S, N661S, Y676D, Y676N, C677R, H678R, D687A, T712S, D724N, D724G, L738H, N742S, A762S, D764G, D764V, S766F, K795E, L797F, I799T, T802P, S815C, M816A, I824T, C839S, K852E, S560G, V585A, I599V, I648V, S663P, L675P, T711A, F744L, L746S, F755L, L804P, M816T, and F840S.

In one embodiment the DD may include the mutation H653A. In one embodiment, the DD may comprise the amino acid sequence of SEQ ID NO. 509. In one embodiment, the DD may include the mutation F736A. In one embodiment, the DD may comprise the amino acid sequence of SEQ ID NO. 227. In one embodiment, the DD may comprise the mutation D764A. In one embodiment, the DD comprises the amino acid sequence of SEQ ID NO. 510. In one embodiment, the DD may include the mutation Y612F. In one aspect, the DD may comprise the amino acid sequence of SEQ ID NO. 506. In one embodiment, the DD may include the Y612W mutation. In one aspect, the DD may include the amino acid sequence of SEQ ID NO. 507. In one embodiment, the DD may include the mutation Y612A. In one embodiment the DD may comprise the amino acid sequence of SEQ ID NO. 508. In one embodiment, the DD may include the mutation D64N. In some aspects, the DD may comprise the amino acid sequence of SEQ ID NO. 505.

In some embodiments, the SRE of the present invention may be appended to a payload. In some aspects, the payload may be an immunotherapeutic agent. In some aspects, the immunotherapeutic agent may be selected from a chimeric antigen receptor (CAR) and a cytokine-cytokine receptor fusion polypeptide.

In some embodiments the CAR may include an extracellular target moiety, a hinge and transmembrane domain, an intracellular signaling domain; and optionally, one or more co-stimulatory domains. In some embodiments, the CAR may be a standard CAR, a split CAR, an off-switch CAR, an on-switch CAR, a first-generation CAR, a second-generation CAR, a third-generation CAR, or a fourth-generation CAR.

The extracellular target moiety of the CAR may have an affinity of bind to a target molecule on the surface of the cancer cell. In some aspects, the extracellular target moiety of the CAR may be an scFv. In one aspect, the target molecule may be CD19. In some embodiments, the extracellular target moiety of the CAR is a CD19 scFv (SEQ ID NO. 8233). In some embodiments, wherein the hinge and transmembrane domain of the CAR may be paired. The paired hinge and transmembrane domain may be derived from CD8a, CD5, CD4, CD9, CD16, CD22, CD33, CD28, CD37, CD45, CD64, CD80, CD86, CD148, DAP 10, EpoRI, GITR, LAG3, ICOS, Her2, OX40 (CD134), 4-1BB (CD137), CD152, CD154, PD-1, or CTLA-4. In some embodiments, the paired domain may be derived from a transmembrane region of an alpha, beta or zeta chain of a T-cell receptor; or an immunoglobulin selected from IgG1, IgD, IgG4, and an IgG4 Fc region; or the CD3 epsilon chain of a T-cell receptor. In one embodiment, the paired hinge and transmembrane domain of the CAR may be derived from CD8a. In one aspect, the paired hinge and transmembrane domain may comprise the amino acid sequence of SEQ ID NO. 8235. In some embodiments, the CAR of the present invention may include an intracellular domain. The intracellular domain may be derived from CD3zeta or a cell surface molecule selected from the group consisting of FcR gamma, FcR beta, CD3 gamma, CD3 delta, CD3 epsilon, CD5, CD22, CD79a, CD79b, and CD66d. In some embodiments, the co-stimulatory domain may be present. The costimulatory domain may be derived from 4-1BB (CD137) 2B4, HVEM, ICOS, LAG3, DAP10, DAP12, CD27, CD28, OX40 (CD134), CD30, CD40, ICOS (CD278), glucocorticoid-induced tumor necrosis factor receptor (GITR), lymphocyte function-associated antigen-1 (LFA-1), CD2, CD7, LIGHT, NKG2C, and B7-H3. In one aspect the intracellular domain may be derived from CD3 Zeta SEQ ID NO. 8236. In some embodiments, the CAR may include a co-stimulatory domain derived from 4-1BB (SEQ ID NO. 8237). In some aspects, the CAR further may also include a signal sequence. The signal sequence may be derived from CD8α. In some aspects, the signal sequence may comprise the amino acid sequence of SEQ ID NO. 278.

In some embodiments, the immunotherapeutic agent may be a cytokine-cytokine receptor fusion polypeptide. The cytokine-cytokine receptor fusion polypeptide may include the whole or a portion of IL15, fused to the whole or a portion of IL15Ra to produce a IL15-IL15Ra fusion polypeptide. In one embodiment the cytokine-cytokine receptor fusion polypeptide may include amino acid sequence of SEQ ID NO. 8324 fused to the amino acid sequence of SEQ ID NO. 8324 to produce a fusion polypeptide.

In some embodiments, the effector module of the invention may be a DD-CD19 CAR fusion polypeptide. The fusion polypeptide may comprise the amino acid sequence of SEQ ID NO: 8283; 8271-8282 or 8284. In some embodiments, the effector module of the invention may be a DD-IL15-IL15Ra fusion polypeptide (SEQ ID NO: 8338; 8334-8337 or 8339-8343).

In some embodiments, the SRE may be responsive to one or more stimuli. The stimulus may be a small molecule such as but not limited to Tadalafil, Vardenafil, Sildenafil, Avanafil, Lodenafil, Mirodenafil, Udenafil, Benzamidenafil, Dasantafil, and Beminafil. In one aspect, the small molecule may be Tadalafil.

The present invention also provides a pharmaceutical composition which may include the compositions described herein and a pharmaceutically acceptable excipient.

The present invention also provides polynucleotides encoding the compositions and the pharmaceutical compositions described herein.

Also provided herein are immune cells for adoptive transfer. The immune cells may express the compositions, pharmaceutical compositions, the polynucleotides, or the vectors described herein.

The present invention also provides methods of inducing an immune response in a cell. Such methods may include administering to the cell, a therapeutically effective amount of any of the pharmaceutical composition and administering to the cell, a therapeutically effective amount of a stimulus to modulate the expression of the immunotherapeutic agent. In some embodiments, the stimulus may be a ligand. In some aspects, the immunotherapeutic agent may be capable of inducing an immune response in the cell, in response to the stimulus.

Methods of reducing tumor burden using the compositions described herein are also provided. Such methods may include administering to the subject a therapeutically effective amount of the immune cells described herein and administering to the subject a therapeutically effective amount of a stimulus. In some embodiments, the stimulus may be a ligand. In some embodiments, the stimulus may be able to modulate the expression of the immunotherapeutic agent, thereby reducing the tumor burden. In some embodiments, the ligand is Tadalafil. In some aspects the Tadalafil may be administered to the subject at a dose ranging from about 0.1 mg/kg to about 100 mg/kg body weight of the subject. In some aspects, the Tadalafil may be administered to the subject at a dose of 10 mg/kg body weight of the subject. In some aspects, the Tadalafil may be administered to the subject at a dose of 30 mg/kg body weight of the subject. In some aspects, the Tadalafil may be administered to the subject at a dose of 100 mg/kg body weight of the subject.

BRIEF DESCRIPTION OF THE DRAWINGS

The foregoing and other objects, features and advantages will be apparent from the following description of particular embodiments of the invention, as illustrated in the accompanying drawings. The drawings are not necessarily to scale; emphasis instead being placed upon illustrating the principles of various embodiments of the invention.

FIG. 19G shows IL2 and IFNγ levels obtained from the supernatants of cocultures of effector and target cells in the presence of vardenafil.

DETAILED DESCRIPTION OF THE INVENTION

Figure 1:
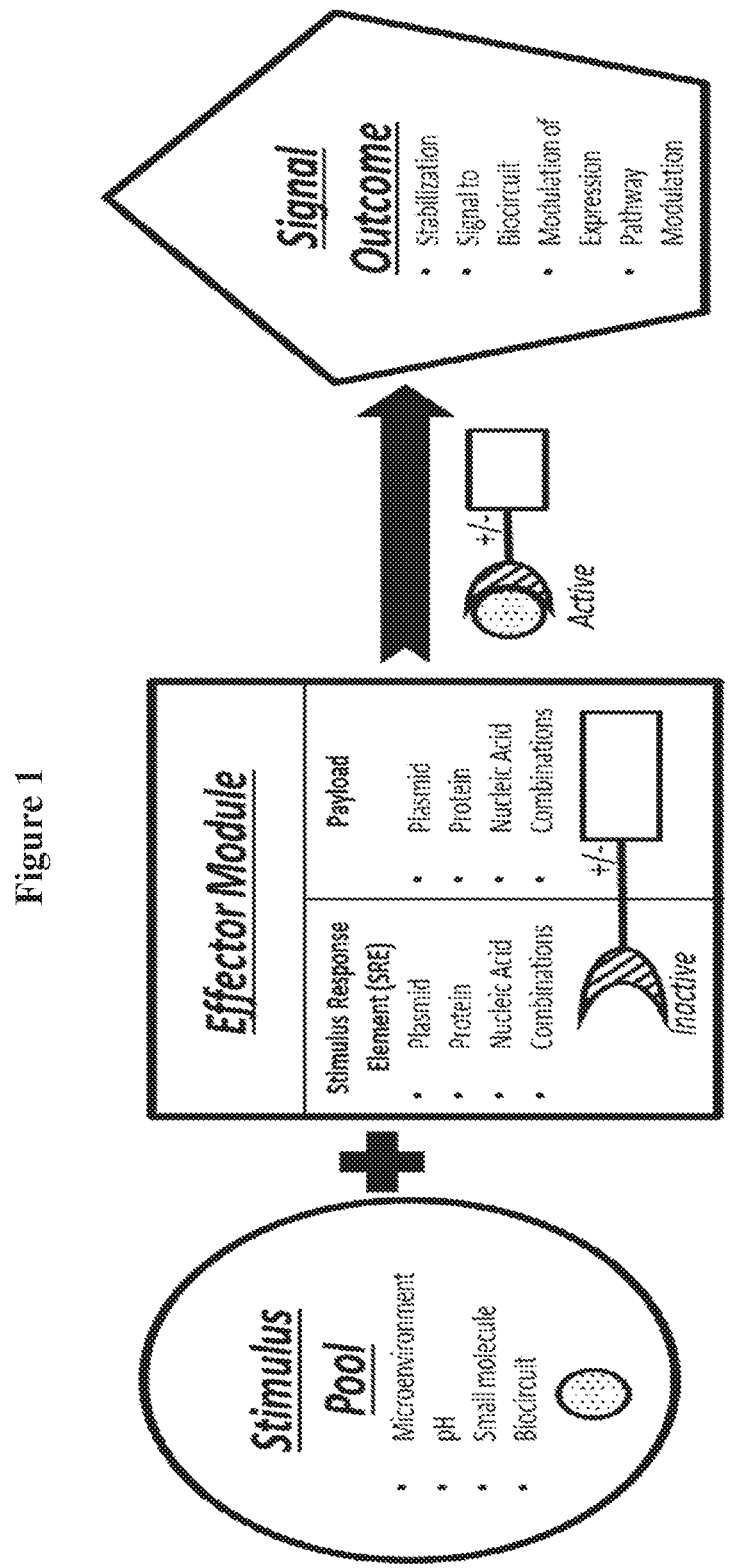
FIG. 1 shows an overview diagram of a biocircuit system of the invention. The biocircuit comprises a stimulus and at least one effector module responsive to a stimulus, where the response to the stimulus produces a signal or outcome. The effector module comprises at least one stimulus response element (SRE) and one payload.

The details of one or more embodiments of the invention are set forth in the accompanying description below. Although any materials and methods similar or equivalent to those described herein can be used in the practice or testing of the present invention, the preferred materials and methods are now described. Other features, objects and advantages of the invention will be apparent from the description. In the description, the singular forms also include the plural unless the context clearly dictates otherwise. Unless defined otherwise, all technical and scientific terms used herein have the

I. INTRODUCTION

Protein Regulation

The ability to conditionally control protein levels is a powerful tool in gene and cell therapy. Techniques to control protein expression on a genetic level have been widely studied. The Cre-Lox technology provides a useful approach to activate or inactivate genes. Tissue or cell specific promoters can be used to control spatial and temporal expression of genes of interest. However, this system is limited in application due to the irreversible nature of the perturbation. The transcription of the gene of interest can be conditionally regulated using tools such as Doxycycline (Dox)-inducible system. Alternatively, the stability of mRNA can be regulated using RNA interference techniques. However, methods targeting DNA or RNA are slow acting, irreversible and have low efficiency.

Direct manipulation of activities at the protein level provides significant advantages in flexibility, reversibility and speed. Strategies which directly trigger a cell's natural degradation system have been developed. Szostak and colleagues showed that a small peptide sequence could be fused to the N-terminus of a protein of interest to modulate protein stability (Park, E-C., et al., *Proc. Natl. Acad. Sci. U.S.A.* 1992, 89:1249-1252). Varshavsky and coworkers isolated a temperature-sensitive peptide sequence that greatly reduced the half-life of dihydrofolate reductase (DHFR) at the non-permissive temperatures (Dohmen et al. *Science* 1994, 263: 1273-1276). These mutants have been widely used to study protein functions in yeast (Labib et al. *Science* 2000, 288: 1643-1646; and Kanemaki et al. *Nature* 2003, 423:720-724).

Subsequently, reversible systems employing a rapamycin derivative for the regulation of GSK-3β kinase fused to an unstable triple-mutant of the FRB domain (FRB*) were developed. The rapamycin derivative induces dimerization of the FRB*-GSK-3β and endogenous FKBP12 and stabilizes the FRB* fusion thus restoring the function of the fused kinase. (Stankunas et al., Mol Cell. 2003; 12:1615-1624 and Liu et al., Nature. 2007; 446:79-82).

Building on the FRB* domain system, Banaszynski, et al., developed a cell-permeable ligand system using mutants of FKBP12 protein which were engineered to be unstable in the absence of a high-affinity ligand, Shield-1. (Banaszynski et al., Cell. 2006; 126:995-1004). They termed these unstable domains, destabilizing domains (DDs).

The FKBP/shield-1 tuning system has been successfully used in several studies to control target proteins. For example, Dettwier et al., fused FKBP to tune the express of NADPH P450 oxidoreductase (POR) (Dettwier et al., *PLoS One,* 2014, 9(11): e1 13540).

The FKBP DD-shield system has been used in cell lines, transgenic mice, protozoan *Entamoeba histolytica*, the flatworm *Caenorhabditis elegans*, the medaka, and transgenic xenografts to investigate the activity of a protein of interest (Maynard-Smith et al., *J Biol Chem.* 2007, 282(34): 24866-24872; Liu et al., *Int J Parasitol.* 2014, 44(10):729-735; Cho et al., *PLoS One.* 2013, 8(8): e72393); Banaszynski et al. *Nat Med.* 2008, 14(10):1123-1127; Rodriguez and Wolfgang, *Chem Biol.* 2011, 19(3):391-398; and Froschauer et al., *PLoS One,* 2015, 10(7): e0131252), for iPSC reprogramming (Sui et al., *Stem cell Reports.,* 2014, 2(5): 721-733).

In addition, the destabilizing domain has been used for the conditional knock-down or knock-out of the target gene fused with the destabilizing domain. Park et al achieved this genomic engineering by CRISPR/Cas9-mediated homologous recombination and a donor template coding for a resistance cassette and the DD-tagged TCOF 1 sequence (Park et al., *PLoS One.* 2014, 9(4): e95101).

More recently protein switches useful as biosensors as well as new chimeric antigen receptors and other small molecule stabilization frameworks have been disclosed (An W, et al. *PLoS ONE,* 2015, 10(12): e0145783. doi: 10.1371/journal.pone.0145783; Nicholes, et al., *Protein Engineering, Design & Selection,* 2016, vol. 29 no. 2, pp. 77-85; Nath, et al., *Biochemical and Biophysical Research Communications,* 2016, 470: 411 e416); Stevers, et al., *PNAS,* 2016, vol. 119, no. 9, pp. E112-1161; Juillerat, A. et al., *Sci. Rep.* 2016, 6: 18950; Roybal, *Cell,* 2016, vol. 164, pp. 1-10; and Morsut, *Cell,* 2016, vol. 164, pp. 1-12).

One drawback of the FKBP/Shield-1 is that Shield-1 is a novel drug whose biodistribution is not fully characterized and it is not known to what extent Shield-1 crosses the blood-brain barrier.

Other DD ligand pairs include estrogen receptor domains which can be regulated by several estrogen receptor antagonists (Miyazaki et al., J Am Chem. Soc., 2012, 134(9): 3942-3945), and fluorescent destabilizing domain (FDD) derived from bilirubin-inducible fluorescent protein, UnaG. A FDD and its cognate ligand bilirubin (BR) can induce degradation of a protein fused to the FDD (Navarro et al., ACS Chem Biol., 2016, June 6, Epub). Other known DDs and their applications in protein stability include those described in U.S. Pat. Nos. 8,173,792 and 8,530,636, the contents of which are each incorporated herein by reference in their entirety.

In an orthogonal approach, the destabilizing domains of the bacterial dihydrofolate reductase (ecDHFR) were explored. (Iwamoto et al., *Chem Biol.* 2010, 17(9):981-988; and Tai et al., *PLoS One.* 2012, 7(9): e46269). Numerous inhibitors of DHFR have been developed as drugs and one such inhibitor Trimethoprim (TMP), inhibits ecDHFR much more potently than mammalian DHFR providing specificity to the interaction. Additionally, TMP is commercially available and has desirable pharmacological properties making this protein-ligand pair ideal for development for use as a biocircuit (Iwamoto, et al., Chem Biol. (2010) September 24; 17(9): 981-988).

The present invention provides novel protein domains displaying small molecule dependent stability. Such protein domains are called destabilizing domains (DDs). In the absence of its binding ligand, the DD is destabilizing and causes degradation of a payload fused to the DD (e.g., a protein of interest (POI), while in the presence of its binding ligand, the fused DD and payload can be stabilized and its stability is dose dependent. Methods for tuning the expression level and activity of a protein of interest using the DDs, effector modules, biocircuit systems and compositions of the invention are also provided. In some embodiments, the SRE may be a destabilizing domain (DD). In some examples, the DD may be a portion or region of human protein PDE5. In this context, the biocircuit system is a DD biocircuit system.

The present invention expands upon the technology of tuning protein stability using novel destabilizing domains derived from human PDE5 protein. The destabilization and stabilization of a protein of interest, e.g., a transgene for gene therapy, can be controlled by PDE5 mutant DDs having destabilizing or stabilizing properties and their ligands, e.g. Sildenafil and Vardenafil specifically binding to such protein domains. The presence and/or absence of a small molecule ligand can tune the activity of a payload (e.g., a protein of interest) that is operably linked to the destabilizing domain.

Immunotherapy

Cancer immunotherapy aims' at the induction or restoration of the reactivity of the immune system towards cancer. Significant advances in immunotherapy research have led to the development of various strategies which may broadly be classified into active immunotherapy and passive immunotherapy. In general, these strategies may be utilized to directly kill cancer cells or to counter the immunosuppressive tumor microenvironment. Active immunotherapy aims at induction of an endogenous, long-lasting tumor-antigen specific immune response. The response can further be enhanced by non-specific stimulation of immune response modifiers such as cytokines. In contrast, passive immunotherapy includes approaches where immune effector molecules such as tumor-antigen specific cytotoxic T cells or antibodies are administered to the host. This approach is short lived and requires multiple applications.

Despite significant advances, the efficacy of current immunotherapy strategies is limited by associated toxicities. These are often related to the narrow therapeutic window associated with immunotherapy, which in part, emerges from the need to push therapy dose to the edge of potentially fatal toxicity to get a clinically meaningful treatment effect. Further, dose expands in vivo since adoptively transferred immune cells continue to proliferate within the patient, often unpredictably.

A major risk involved in immunotherapy is the on-target but off tumor side effects resulting from T-cell activation in response to normal tissue expression of the tumor associated antigen (TAA). Clinical trials utilizing T cells expressing T-cell receptor against specific TAA reported skin rash, colitis and hearing loss in response to immunotherapy.

Immunotherapy may also produce on target, on-tumor toxicities that emerge when tumor cells are killed in response to the immunotherapy. The adverse effects include tumor lysis syndrome, cytokine release syndrome and the related macrophage activation syndrome. Importantly, these adverse effects may occur during the destruction of tumors, and thus even a successful on-tumor immunotherapy might result in toxicity. Approaches to regulatably control immunotherapy are thus highly desirable since they have the potential to reduce toxicity and maximize efficacy.

The present invention provides systems, compositions, immunotherapeutic agents and methods for cancer immunotherapy. These compositions provide tunable regulation of gene expression and function in immunotherapy. The present invention also provides biocircuit systems, effector modules, stimulus response elements (SREs) and payloads, as well as polynucleotides encoding any of the foregoing. In one aspect, the systems, compositions, immunotherapeutic agents and other components of the invention can be controlled by a separately added stimulus, which provides a significant flexibility to regulate cancer immunotherapy. Further, the systems, compositions and the methods of the present invention may also be combined with therapeutic agents such as chemotherapeutic agents, small molecules, gene therapy, and antibodies.

The tunable nature of the systems and compositions of the invention has the potential to improve the potency and duration of the efficacy of immunotherapies. Reversibly silencing the biological activity of adoptively transferred cells using compositions of the present invention allows maximizing the potential of cell therapy without irretrievably killing and terminating the therapy.

In particular, present invention provides methods for fine tuning of immunotherapy after administration to patients. This in turn improves the safety and efficacy of immunotherapy and increases the subject population that may benefit from immunotherapy.

II. COMPOSITIONS OF THE INVENTION

A variety of strategies that can directly control protein, e.g., a transgene, expression and function are available. The present invention provides novel protein domains displaying small molecule dependent stability. Such protein domains are called destabilizing domains (DDs). In the absence of its binding ligand, the DD causes degradation of a payload such as a protein of interest (POI) that is operably linked to the DD, while in the presence of its binding ligand, the fused DD and payload can be stabilized and its stability is dose dependent.

According to the present invention, novel destabilizing domains derived from human hPDE5 (cGMP-specific phosphodiesterase type 5; also referred to as cGMP-specific 3',5'-cyclic phosphodiesterase) protein are provided. The destabilizing domain (DD) mutants are derived from the human PDE5 protein, comprising the amino acid sequence of SEQ ID NO. 1 (encoded by the nucleic acid sequence of SEQ ID NO. 2). The hPDE5 DD mutant may also comprise more than one mutation in the catalytic domain of human PDE5 (SEQ ID NO. 3), encoded by nucleic acid sequence of SEQ ID NO.339, e.g., two, three, four, five or more mutations. These hPDE5 DDs can bind to Sildenafil and/or Vardenafil and be stabilized. In some embodiments, the hPDE5 DD may include a methionine appended to the N terminus of catalytic domain (SEQ ID NO. 237), encoded by SEQ ID NO. 4.

According to the present invention, biocircuit systems are provided which comprise, at their core, at least one effector module system. Such effector module systems comprise at least one effector module having associated, or integral therewith, one or more stimulus response elements (SREs). The overall architecture of a biocircuit system of the invention is illustrated in FIG. 1. In general, a stimulus response element (SRE) may be operably linked to a payload construct which could be any protein of interest (POI) (e.g., an immunotherapeutic agent), to form an effector module. The SRE, when activated by a particular stimulus, e.g., a small molecule, can produce a signal or outcome, to regulate transcription and/or protein levels of the linked payload either up or down by perpetuating a stabilizing signal or destabilizing signal, or any other types of regulation. A much-detailed description of a biocircuit system can be found in co-owned U.S. Provisional Patent Application No. 62/320,864 filed Apr. 11, 2016, 62/466,596 filed Mar. 3, 2017 and the International Publication WO2017/180587 (the contents of each of which are herein incorporated by reference in their entirety). In accordance with the present invention, biocircuit systems, effector modules, SREs and components that tune expression levels and activities of any agents used for immunotherapy are provided. In particular, biocircuit systems and effector modules comprising the novel hPDE5 destabilizing domains discussed herein are provided.

As used herein, a "biocircuit" or "biocircuit system" is defined as a circuit within or useful in biologic systems comprising a stimulus and at least one effector module responsive to a stimulus, where the response to the stimulus produces at least one signal or outcome within, between, as an indicator of, or on a biologic system. Biologic systems are generally understood to be any cell, tissue, organ, organ system or organism, whether animal, plant, fungi, bacterial, or viral. It is also understood that biocircuits may be artificial circuits which employ the stimuli or effector modules taught by the present invention and effect signals or outcomes in acellular environments such as with diagnostic, reporter systems, devices, assays or kits. The artificial circuits may be associated with one or more electronic, magnetic, or radioactive components or parts.

In accordance with the present invention, a biocircuit system may be a destabilizing domain (DD) biocircuit system, a dimerization biocircuit system, a receptor biocircuit system, and a cell biocircuit system. Any of these systems may act as a signal to any other of these biocircuit systems. In some embodiments, the present invention provides biocircuit systems, effector modules and compositions comprising the DDs of the present invention. In one aspect, the biocircuit system is a DD biocircuit system.

In one aspect of the present invention, the biocircuit system is a DD biocircuit system. The DD is a hPDE5 derived DD.

Effector Modules and SREs for Immunotherapy

In accordance with the present invention, biocircuit systems, effector modules, SREs, and components that tune expression levels and activities of any agents used for immunotherapy are provided. As non-limiting examples, an immunotherapeutic agent may be an antibody and fragments and variants thereof, a cancer specific T cell receptor (TCR) and variants thereof, an anti-tumor specific chimeric antigen receptor (CAR), a chimeric switch receptor, an inhibitor of a co-inhibitory receptor or ligand, an agonist of a co-stimulatory receptor and ligand, a cytokine, chemokine, a cytokine receptor, a chemokine receptor, a soluble growth factor, a metabolic factor, a suicide gene, a homing receptor, or any agent that induces an immune response in a cell and a subject.

As stated, the biocircuits of the invention include at least one effector module as a component of an effector module system. As used herein, an "effector module" is a single or multi-component construct or complex comprising at least (a) one or more stimulus response elements (SREs) and (b) one or more payloads (i.e. proteins of interest (POIs)). In the context of the present invention, the SRE is a DD derived from human PDE5 protein.

As used herein a "stimulus response element (SRE)" is a component of an effector module which is joined, attached, linked to or associated with one or more payloads of the effector module and in some instances, is responsible for the responsive nature of the effector module to one or more stimuli. As used herein, the "responsive" nature of an SRE to a stimulus may be characterized by a covalent or non-covalent interaction, a direct or indirect association or a structural or chemical reaction to the stimulus. Further, the response of any SRE to a stimulus may be a matter of degree or kind. The response may be a partial response. The response may be a reversible response. The response may ultimately lead to a regulated signal or output. Such output signal may be of a relative nature to the stimulus, e.g., producing a modulatory effect of between 1% and 100% or a factored increase or decrease such as 2-fold, 3-fold, 4-fold, 5-fold, 10-fold or more.

In some embodiments, the biocircuit system of the present invention comprising a stimulus and an effector module of the invention. The DD of the effector module binds to the stimulus and regulates the stability of the linked payload. The DD may destabilize the protein of interest by a destabilization ratio between 0, and 0.09, wherein the destabilization ratio comprises the ratio of expression, function or level of a protein of interest in the absence of the stimulus specific to the DD to the expression, function or level of the protein of interest that is expressed constitutively, and in the absence of the stimulus specific to the DD. In some embodiments, the DD may stabilize the protein of interest by a stabilization ratio of 1 or more, wherein the stabilization ratio comprises the ratio of expression, function or level of a protein of interest in the presence of the stimulus to the expression, function or level of the protein of interest in the absence of the stimulus.

In some embodiments, the present invention provides methods for modulating protein expression, function or level. In some aspects, the modulation of protein expression, function or level refers to modulation of expression, function or level by at least about 20%, such as by at least about 30%, 40%, 50%, 60%, 70%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%.

According to the present invention, biocircuit systems and effector modules of the invention can be used to regulate the expression and activity of a payload in response to the presence or absence of a ligand that specifically binds to the DD integrated within the biocircuit system and effector module.

In some aspects, DDs, effector modules and biocircuit systems of the invention may be used to regulate the expression, function and activity of a payload in a cell or a subject. The regulation refers to a level of change of its expression, function and activity, by at least about 10%, or at least about 20%, or at least about 30%, or at least about 40%, or at least about 50%, or at least about 60%, or at least about 70%, or at least about 80%, or at least about 85%, or at least about 90%, or at least about 95%, or at least about 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%.

In some embodiments, the mutation co-efficient of the biocircuits of the invention may also be measured as a way of evaluating the ability of the DD to modulate protein expression, function or level. As used herein, the "mutation co-efficient" refers to the expression, function or level or a protein of interest, appended to a particular DD mutant, in the absence of the stimulus specific to the SRE; to the protein expression, function or level of the protein of interest, appended to the corresponding wildtype sequence from which the particular DD mutant is derived and in the absence of the stimulus. The mutation co-efficient is indicative of the contribution of the destabilizing mutations towards the basal expression of the protein independent of the whether the corresponding wildtype protein can be destabilized without any mutations. In some aspects, the mutation co-efficient ratio is at least 0, such as by at least 0.1, 0.2, 0.3, 0.4, 0.5, 0.6, 0.7, 0.8, 0.9, or at least, 0-0.1, 0-0.2, 0-0.3, 0-0.4, 0-0.5, 0-0.6, 0-0.7, 0-0.8, 0-0.9, 0.1-0.2, 0.1-0.3, 0.1-0.4, 0.1-0.5, 0.1-0.6, 0.1-0.7, 0.1-0.8, 0.1-0.9, 0.2-0.3, 0.2-0.4, 0.2-0.5, 0.2-0.6, 0.2-0.7, 0.2-0.8, 0.2-0.9, 0.3-0.4, 0.3-0.5, 0.3-0.6, 0.3-0.7, 0.3-0.8, 0.3-0.9, 0.4-0.5, 0.4-0.6, 0.4-0.7, 0.4-0.8, 0.4-0.9, 0.5-0.6, 0.5-0.7, 0.5-0.8, 0.5-0.9, 0.6-0.7, 0.6-0.8, 0.6-0.9, 0.7-0.8, 0.7-0.9 or 0.8-0.9.

In some embodiments, the present invention provides methods for modulating protein, expression, function or level by measuring the stabilization ratio, destabilization ratio, and/or destabilizing mutation co-efficient. As used herein, the "stabilization ratio" is the ratio of expression, function or level of a protein of interest in response to the stimulus to the expression, function or level of the protein of interest in the absence of the stimulus specific to the SRE. In some aspects, the stabilization ratio is at least 1, such as by at least 1-10, 1-20, 1-30, 1-40, 1-50, 1-60, 1-70, 1-80, 1-90, 1-100, 20-30, 20-40, 20-50, 20-60, 20-70, 20-80, 20-90, 20-95, 20-100, 30-40, 30-50, 30-60, 30-70, 30-80, 30-90, 30-95, 30-100, 40-50, 40-60, 40-70, 40-80, 40-90, 40-95, 40-100, 50-60, 50-70, 50-80, 50-90, 50-95, 50-100, 60-70, 60-80, 60-90, 60-95, 60-100, 70-80, 70-90, 70-95, 70-100, 80-90, 80-95, 80-100, 90-95, 90-100 or 95-100. As used herein, the "destabilization ratio" is the ratio of expression, function or level of a protein of interest in the absence of the stimulus specific to the effector module to the expression, function or level of the protein of interest, that is expressed constitutively and in the absence of the stimulus specific to the SRE. As used herein "constitutively" refers to the expression, function or level a protein of interest that is not linked to an SRE, and is therefore expressed both in the presence and absence of the stimulus to the SRE. As used herein, the "destabilizing mutation co-efficient" may be defined as the ratio of expression or level of a protein of interest that is appended to a DD, in the absence of the stimulus specific to the effector module to the expression, function or level of the protein that is appended to the wild type protein from which the DD is derived. In some aspects, the destabilization ratio and/or the destabilizing mutation co-efficient is at least 0, such as by at least 0.1, 0.2, 0.3, 0.4, 0.5, 0.6, 0.7, 0.8, 0.9, or at least, 0-0.1, 0-0.2, 0-0.3, 0-0.4, 0-0.5, 0-0.6, 0-0.7, 0-0.8, 0-0.9, 0.1-0.2, 0.1-0.3, 0.1-0.4, 0.1-0.5, 0.1-0.6, 0.1-0.7, 0.1-0.8, 0.1-0.9, 0.2-0.3, 0.2-0.4, 0.2-0.5, 0.2-0.6, 0.2-0.7, 0.2-0.8, 0.2-0.9, 0.3-0.4, 0.3-0.5, 0.3-0.6, 0.3-0.7, 0.3-0.8, 0.3-0.9, 0.4-0.5, 0.4-0.6, 0.4-0.7, 0.4-0.8, 0.4-0.9, 0.5-0.6, 0.5-0.7, 0.5-0.8, 0.5-0.9, 0.6-0.7, 0.6-0.8, 0.6-0.9, 0.7-0.8, 0.7-0.9 or 0.8-0.9.

The SRE of the effector module may be selected from, but is not limited to, a peptide, peptide complex, peptide-protein complex, protein, fusion protein, protein complex, protein-protein complex. The SRE may comprise one or more regions derived from any natural or mutated protein, or antibody. In this aspect, the SRE is an element, when responding to a stimulus, can tune intracellular localization, intramolecular activation, and/or degradation of payloads.

In some embodiments, effector modules of the present invention may comprise additional features that facilitate the expression and regulation of the effector module, such as one or more signal sequences (SSs), one or more cleavage and/or processing sites, one or more targeting and/or penetrating peptides, one or more tags, and/or one or more linkers. Additionally, effector modules of the present invention may further comprise other regulatory moieties such as inducible promoters, enhancer sequences, microRNA sites, and/or microRNA targeting sites. Each aspect or tuned modality may bring to the effector module or biocircuit a differentially tuned feature. For example, an SRE may represent a destabilizing domain, while mutations in the protein payload may alter its cleavage sites or dimerization properties or half-life and the inclusion of one or more microRNA or microRNA binding site may impart cellular detargeting or trafficking features. Consequently, the present invention embraces biocircuits which are multifactorial in their tenability. Such biocircuits may be engineered to contain one, two, three, four or more tuned features.

Figure 2:
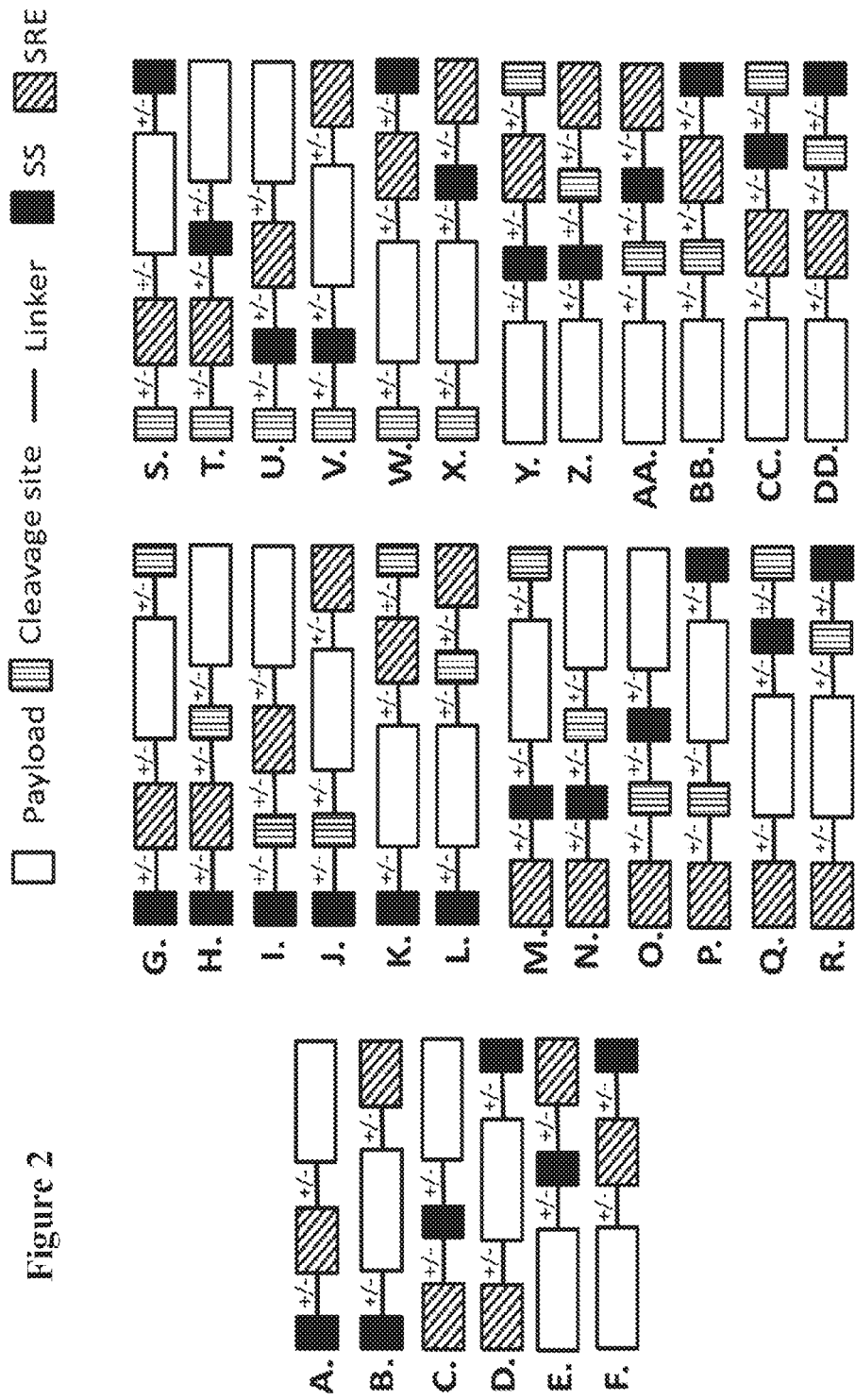
FIG. 2 shows representative effector modules carrying one payload. The signal sequence (SS), SRE and payload may be located or positioned in various arrangements without (A to F) or with (G to Z, and AA to DD) a cleavage site. An optional linker may be inserted between each component of the effector module.

As shown in FIG. 2, representative effector module embodiments comprising one payload, i.e. one immunotherapeutic agent are illustrated. Each components of the effector module may be located or positioned in various arrangements without (A to F) or with (G to Z, and AA to DD) a cleavage site. An optional linker may be inserted between each component of the effector module.

Figure 3:
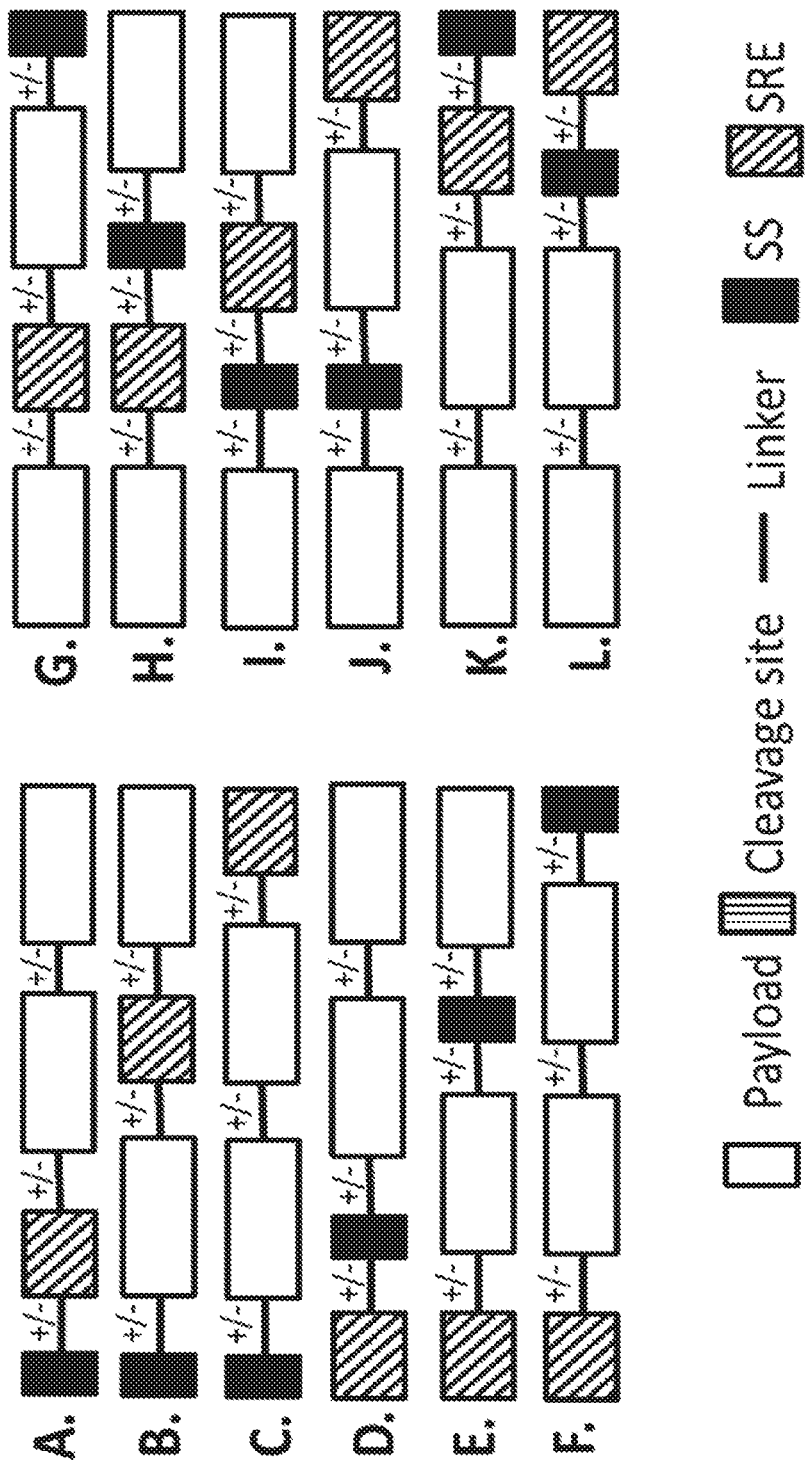
FIG. 3 shows representative effector modules carrying two payloads without a cleavage site. The two payloads may be either directly linked to each other or separated.
Figure 4:
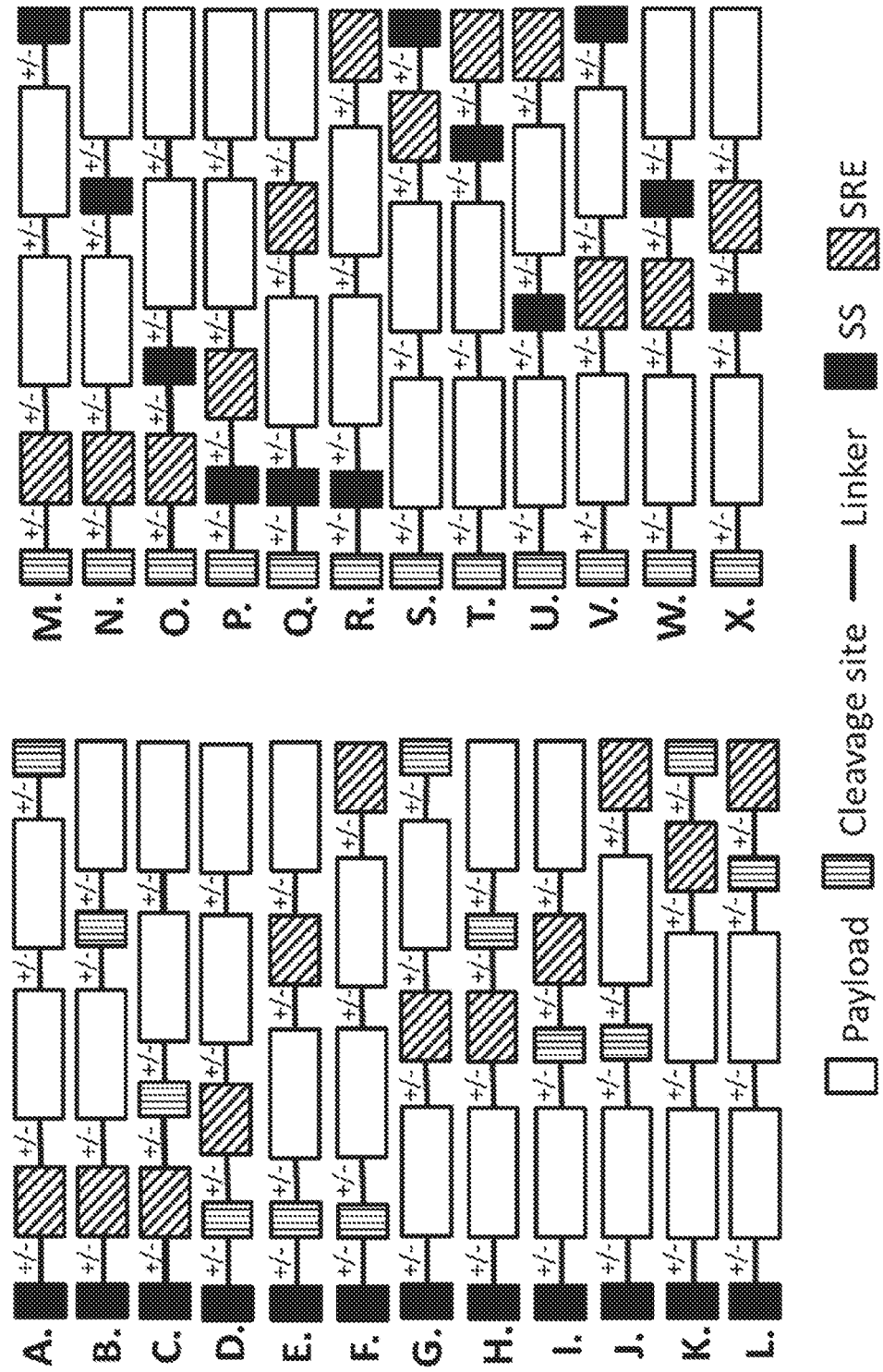
FIG. 4 shows representative effector modules carrying two payloads with a cleavage site. In one embodiment, an SS is positioned at the N-terminus of the construct, while other components: SRE, two payloads and the cleavage site may be located at different positions (A to L). In another embodiment, the cleavage site is positioned at the N-terminus of the construct (M to X). An optional linker may be inserted between each component of the effector module.
Figure 5:
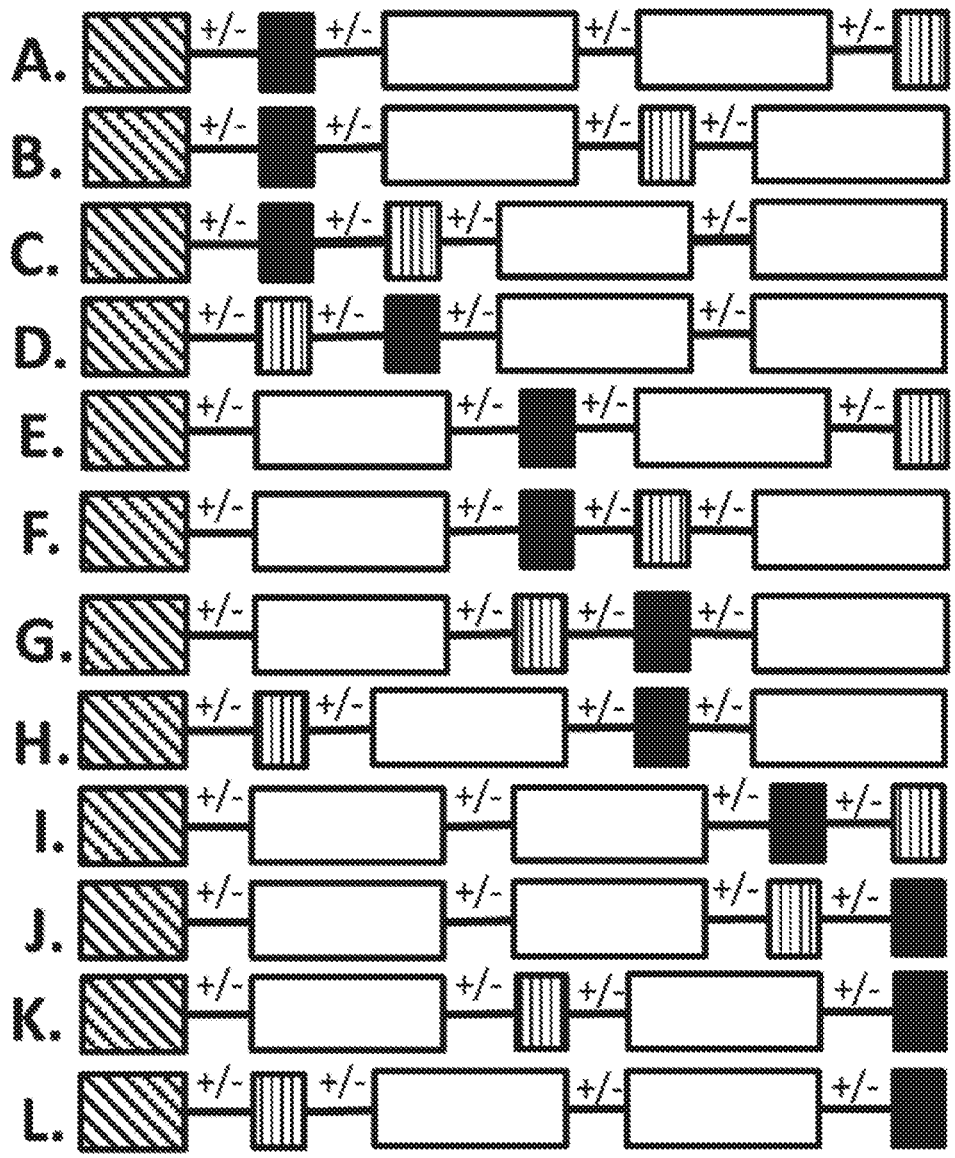
FIG. 5 shows effector modules of the invention carrying two payloads, where an SRE is positioned at the N-terminus of the construct (A to L), while SS, two payloads and the cleavage site can be in any configuration. An optional linker may be inserted between each component of the effector module.
Figure 6:
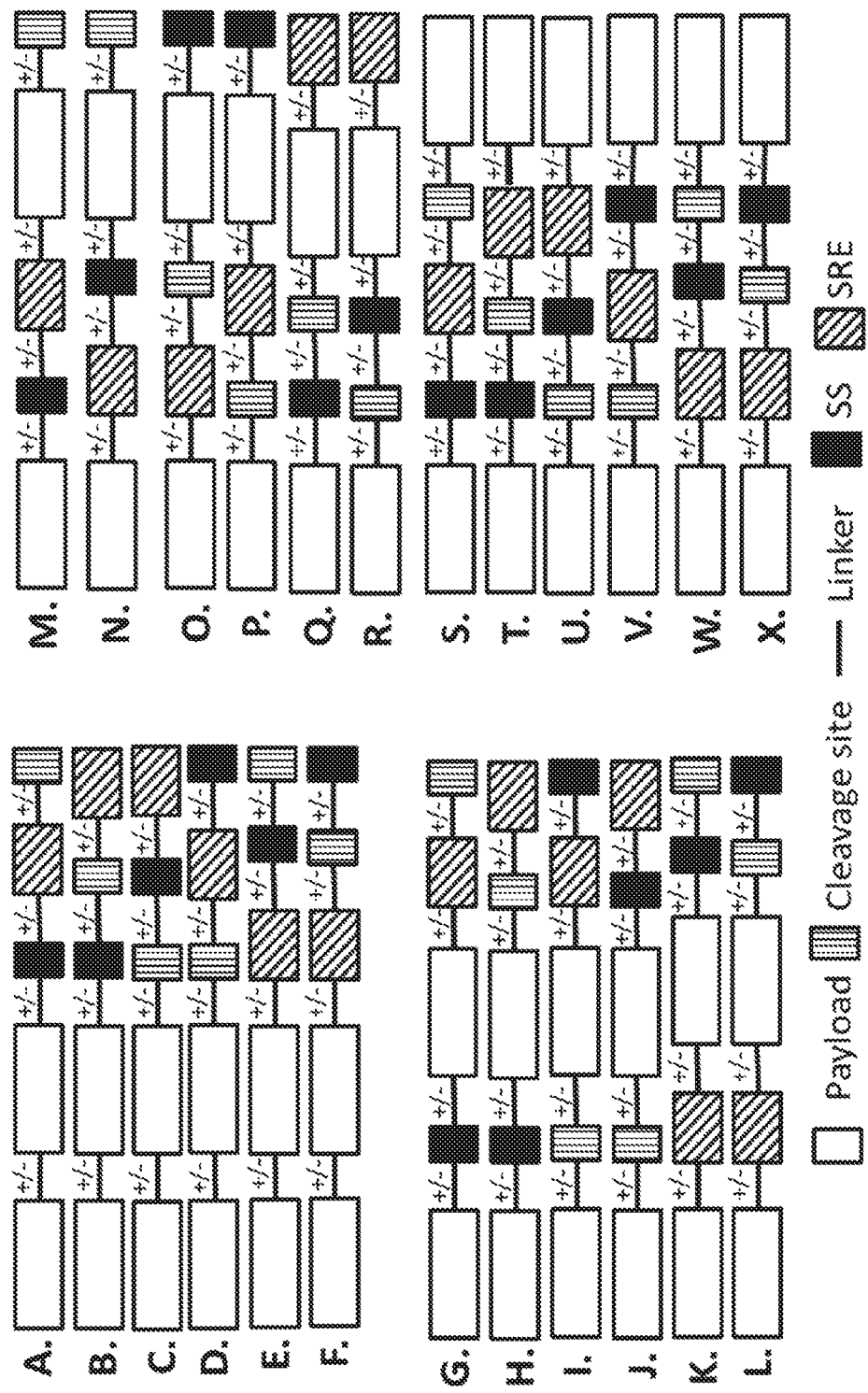
FIG. 6 shows effector modules of the invention carrying two payloads, where either the two payloads (A to F) or one of the two payloads (G to X) is positioned at the N-terminus of the construct (A to L), while SS, SRE and the cleavage site can be in any configuration. An optional linker may be inserted between each component of the effector module.
Figure 7:
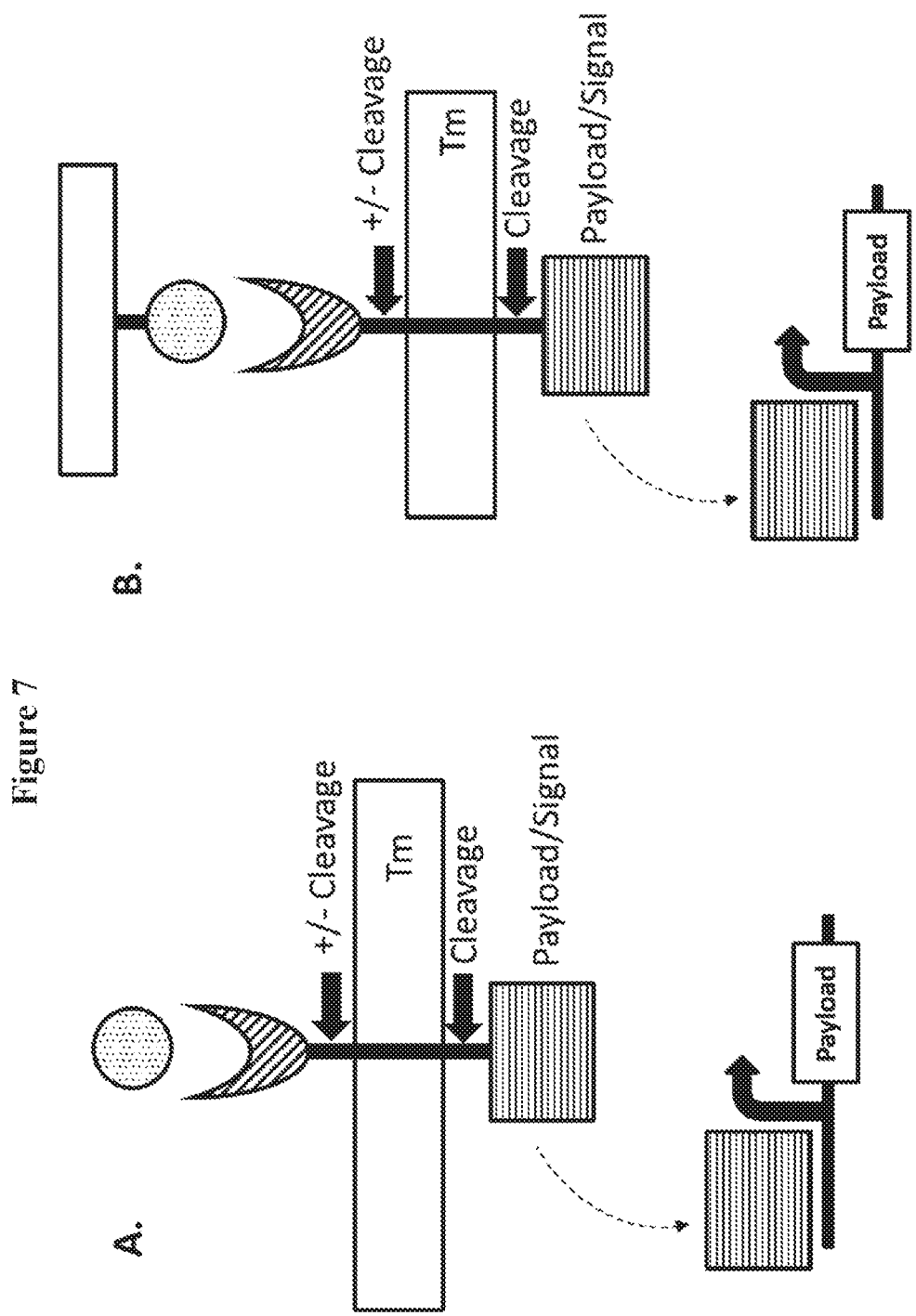
FIG. 7 depicts representative configurations of the stimulus and effector module within a biocircuit system. A trans-membrane effector module is activated either by a free stimulus (A) or a membrane bound stimulus (B) which binds to SRE. The response to the stimulus causes the cleavage of the intracellular signal/payload, which activates downstream effector/payload.
Figure 8:
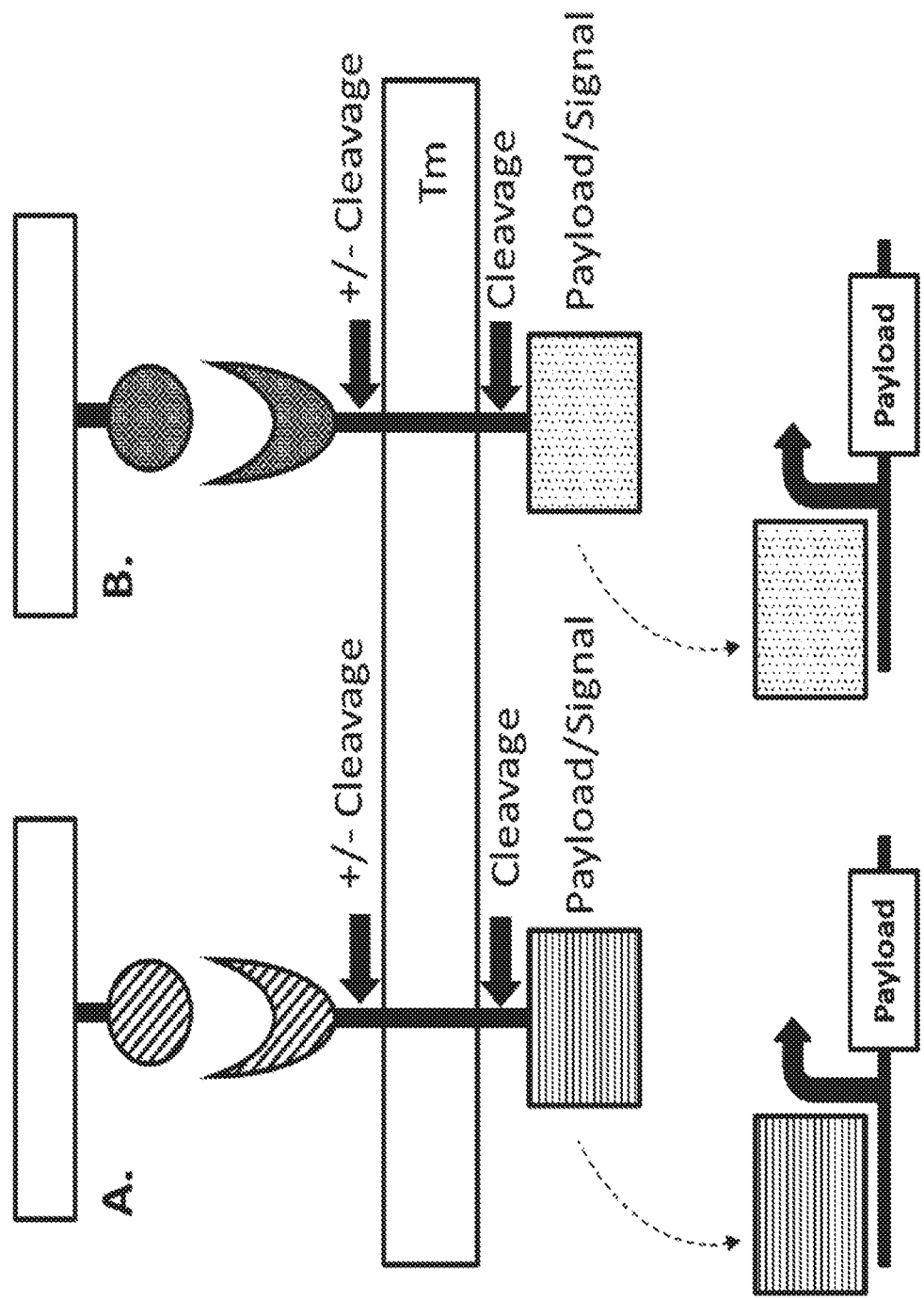
FIG. 8 depicts a dual stimulus-dual presenter biocircuit system, where two bound stimuli (A and B) from two different presenters (e.g., different cells) bind to two different effector modules in a single receiver (e.g., another single cell) simultaneously and create a dual-signal to downstream payloads.
Figure 9:
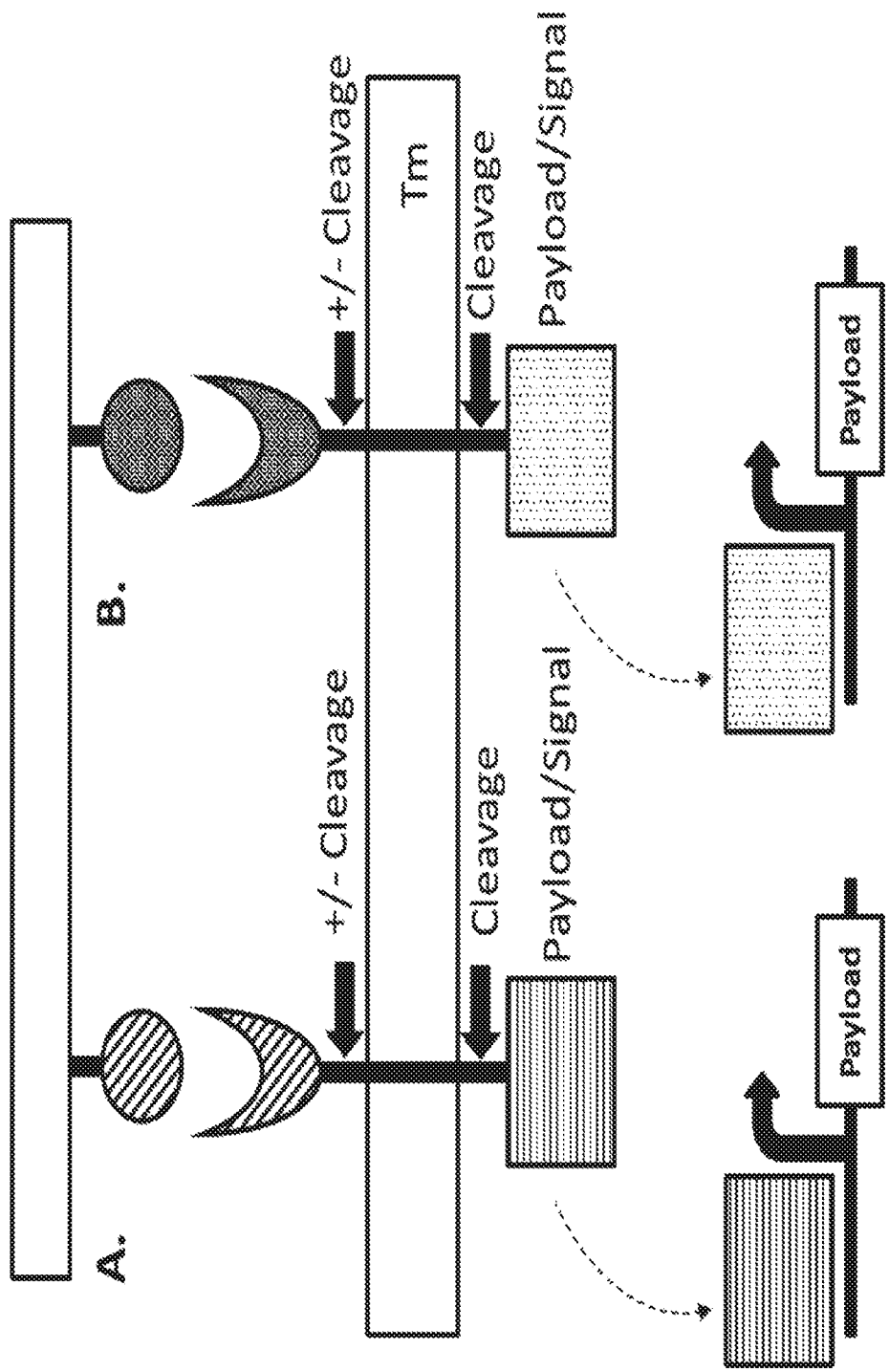
FIG. 9 depicts a dual stimulus-single presenter biocircuit system, where two bound stimuli (A and B) from the same presenter (e.g., a single cell) bind to two different effector modules in another single cell simultaneously and create a dual-signal.
Figure 10:
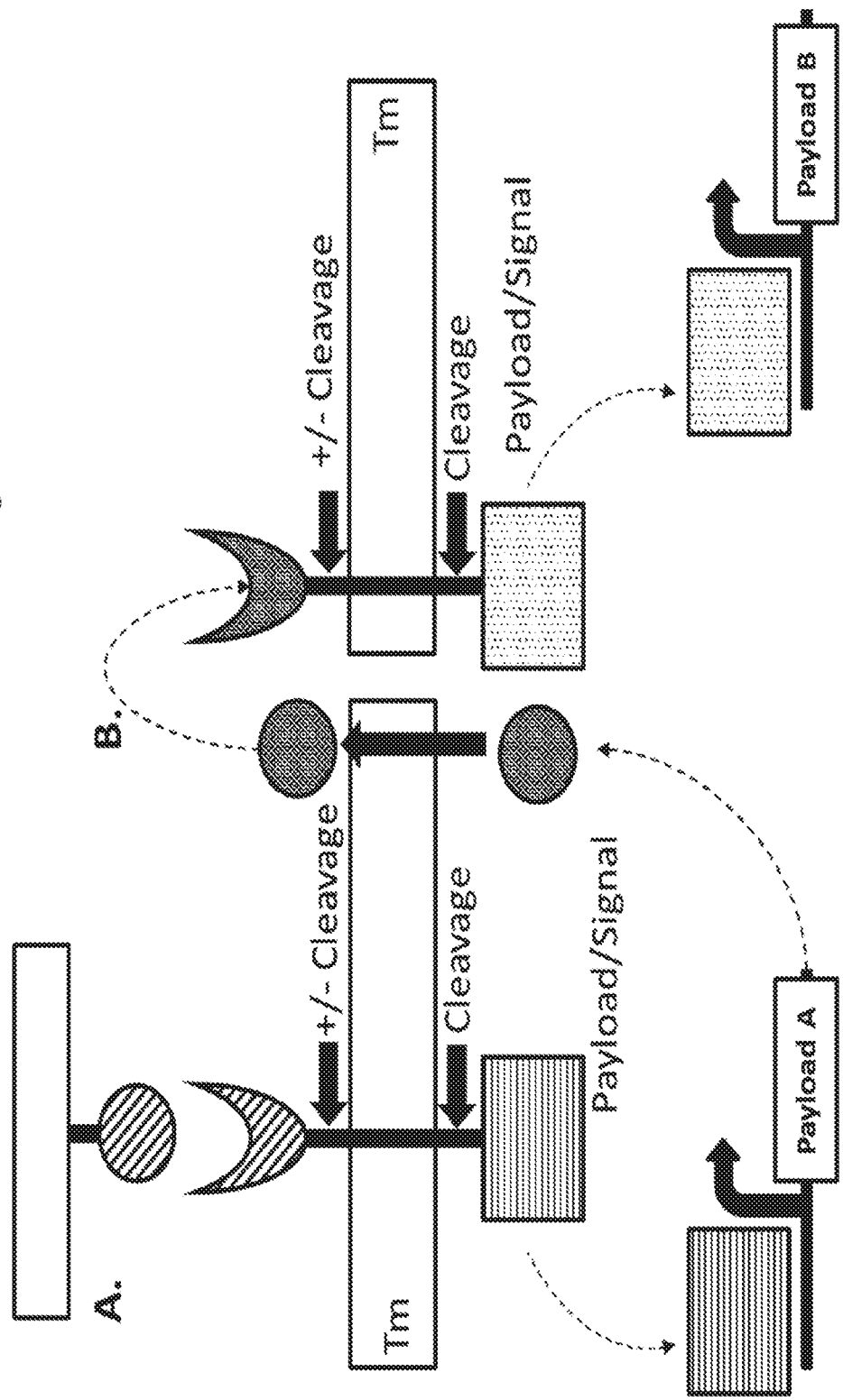
FIG. 10 depicts a single-stimulus-bridged receiver biocircuit system. In this configuration, a bound stimulus (A) binds to an effector module in the bridge cell and creates a signal to activate a payload which is a stimulus (B) for another effector module in the final receiver (e.g., another cell).
Figure 11:
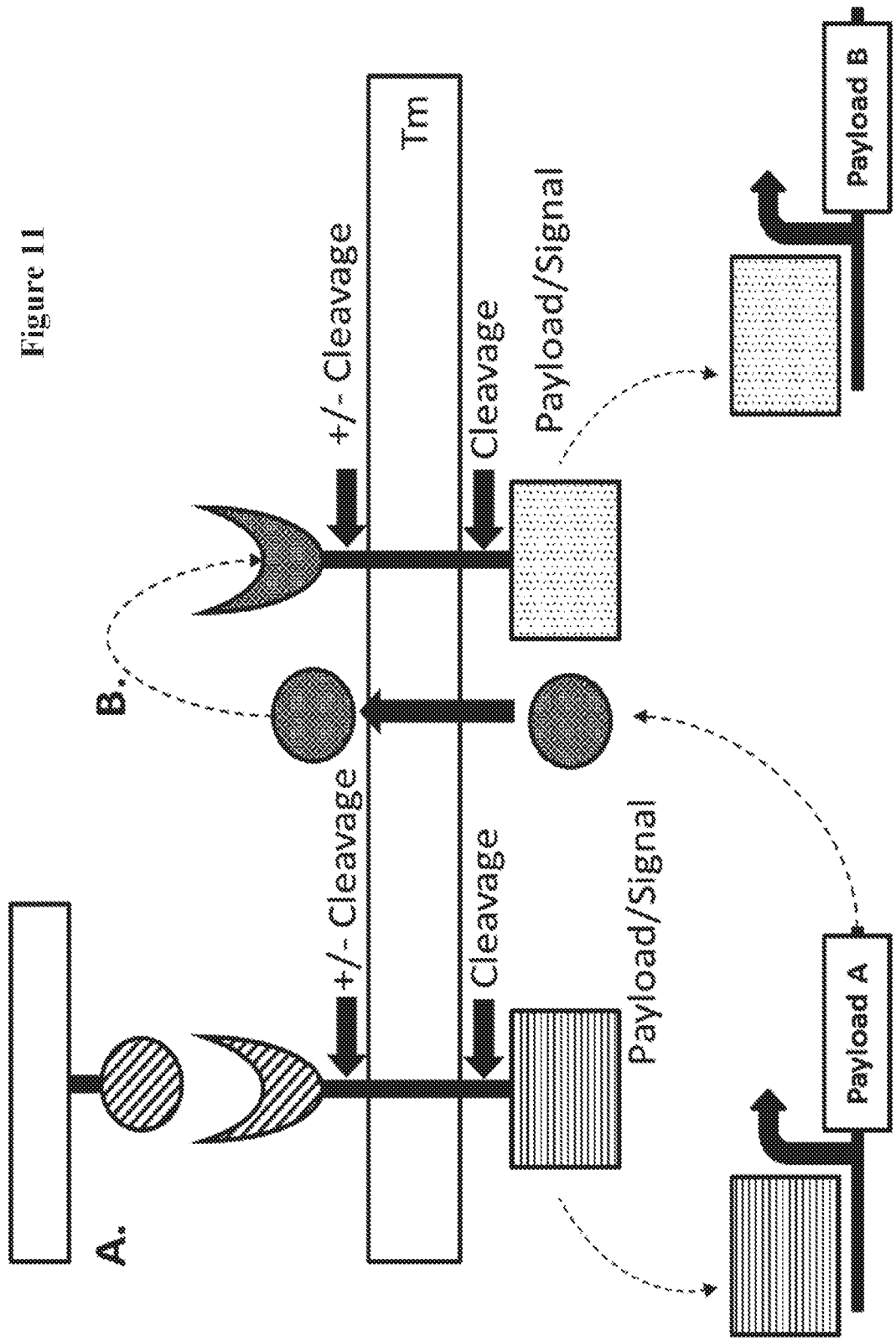
FIG. 11 depicts a single stimulus-single receiver biocircuit system, wherein the single receiver contains the two effector modules which are sequentially activated by a single stimulus.
Figure 12:
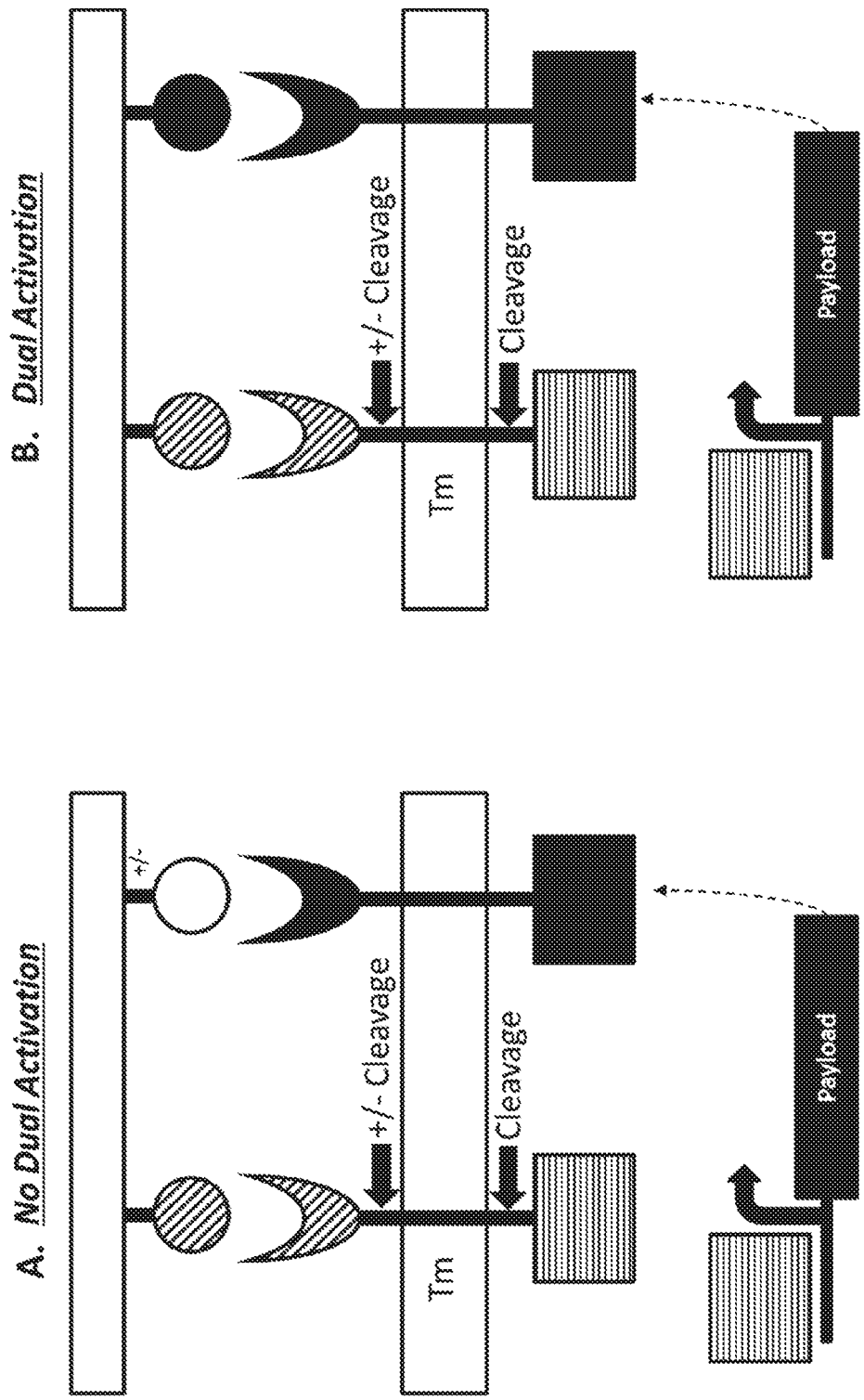
FIG. 12 depicts a biocircuit system which requires a dual activation. In this embodiment, one stimulus must bind the transmembrane effector module first to prime the receiver cell being activated by the other stimulus. The receiver only activates when it senses both stimuli (B).
Figure 13:
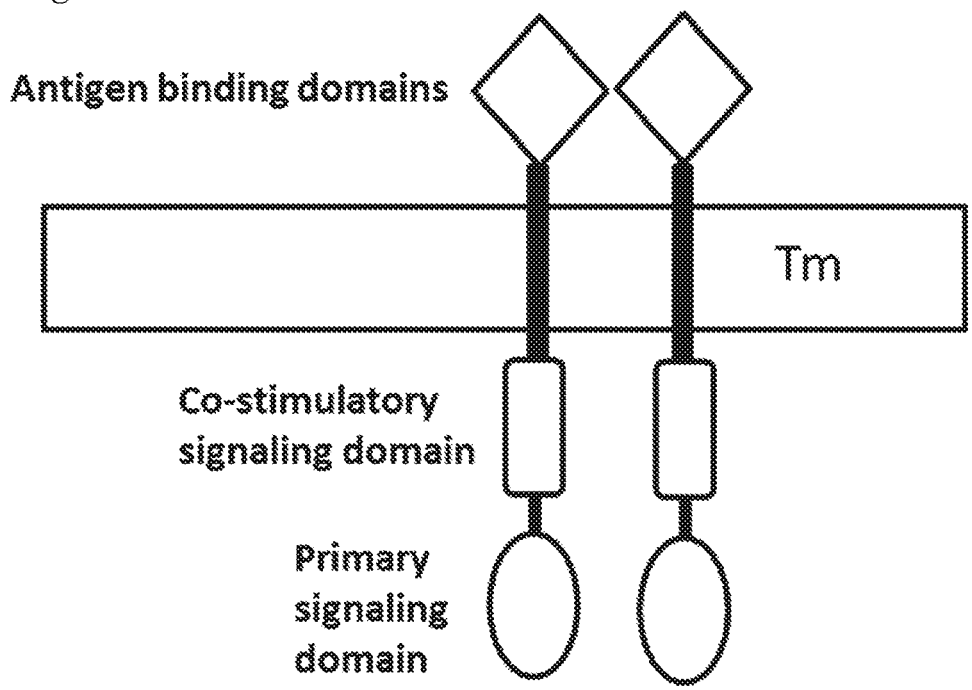
FIG. 13 depicts a standard effector module of a chimeric antigen receptor (CAR) system which comprises an antigen binding domain as an SRE, and signaling domain(s) as payload.
Figure 14:
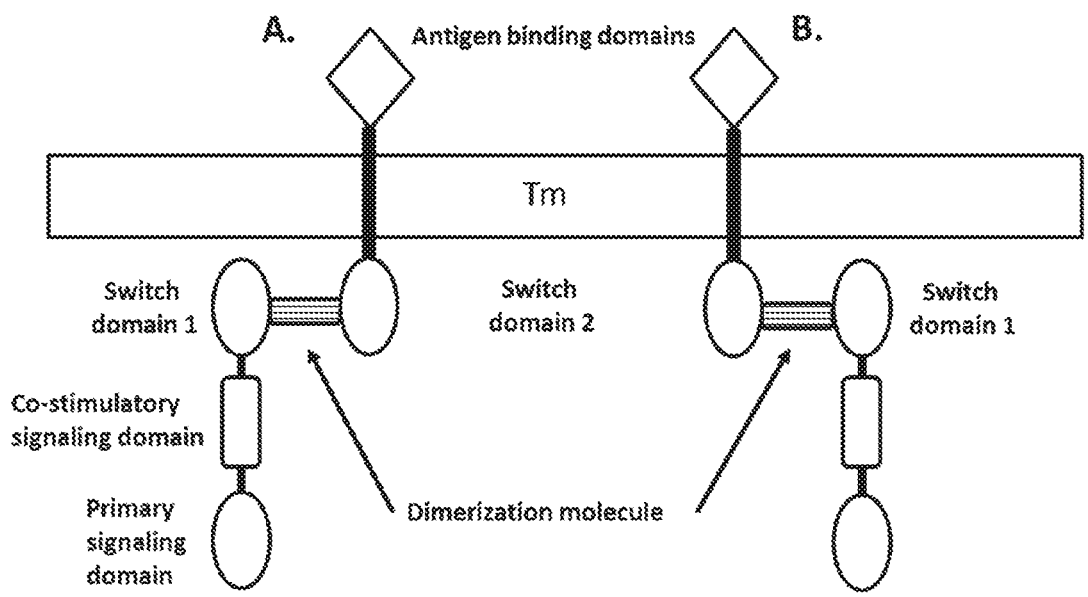
FIG. 14 depicts the structure design of a regulatable CAR system, where the trans-membrane effector modules comprise antigen binding domains sensing an antigen and a first switch domain and the intracellular module comprises a second switch domain and signaling domains. A stimulus (e.g., a dimerization small molecule) can dimerize the first and second switch domains and assemble an activated CAR system.
Figure 15:
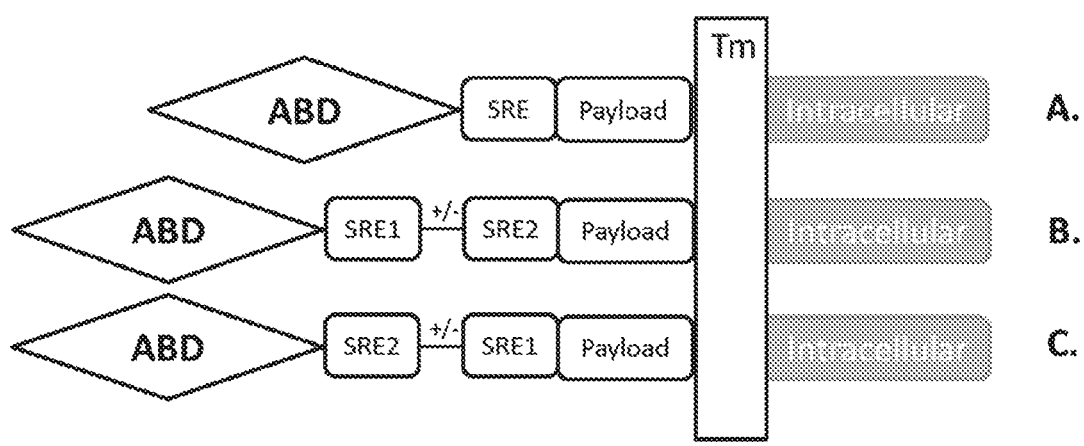
FIG. 15 shows schematic representation of CAR systems having one (A) or two (B and C) SREs incorporated into the effector module.
Figure 16:
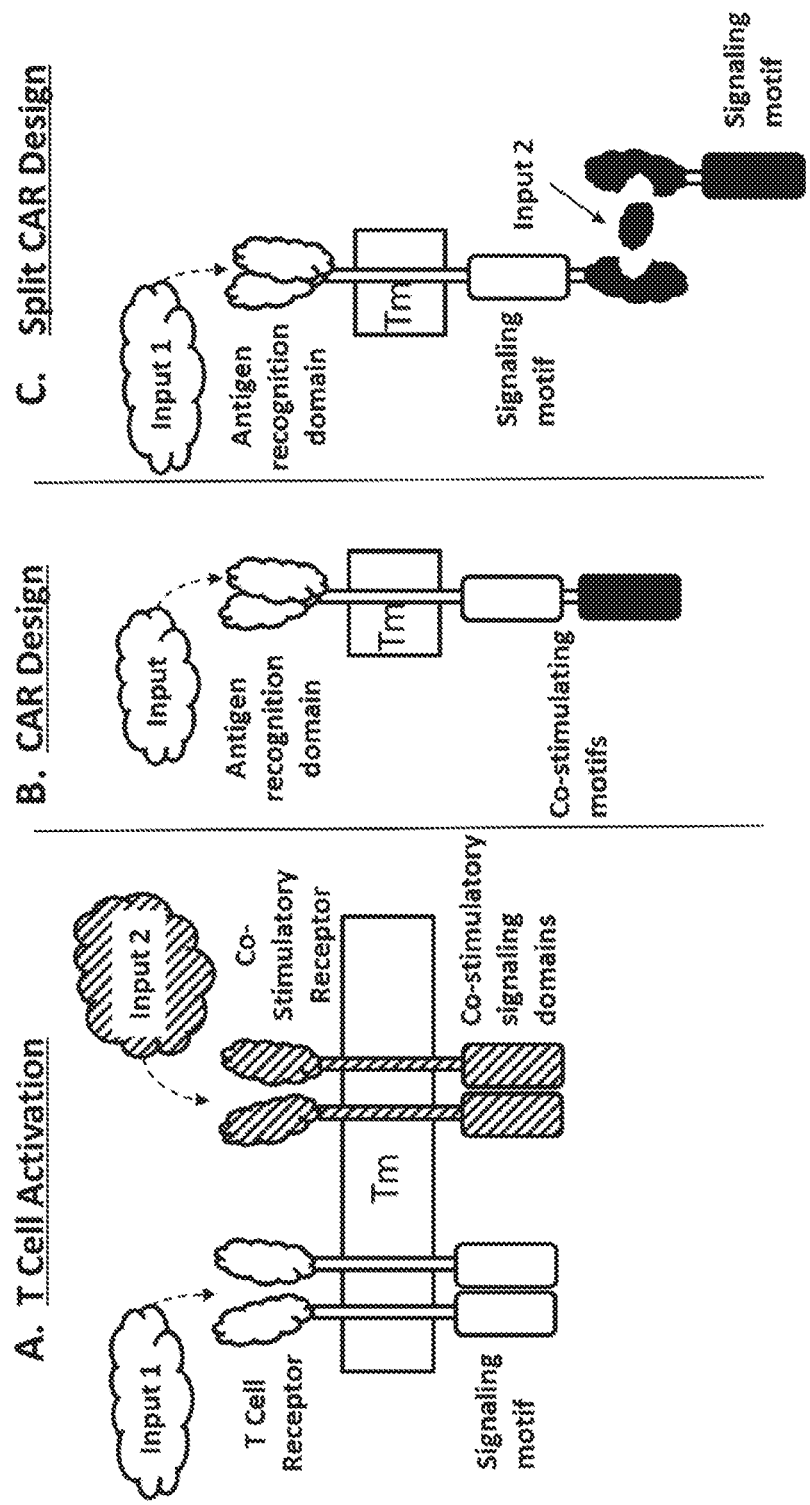
FIG. 16 depicts a split CAR design to control T cell activation by a dual stimulus (e.g., an antigen and small molecule). (A) shows normal T cell activation which entails a dual activation of TCR and co-stimulatory receptor. The regular CAR design (B) combines the antigen recognition domain with TCR signaling motif and co-stimulatory motif in a single molecule. The split CAR system separates the components of the regular CAR into two separate effector modules which can be reassembled when a heterodimerizing small molecule (stimulus) is present.
Figure 17:
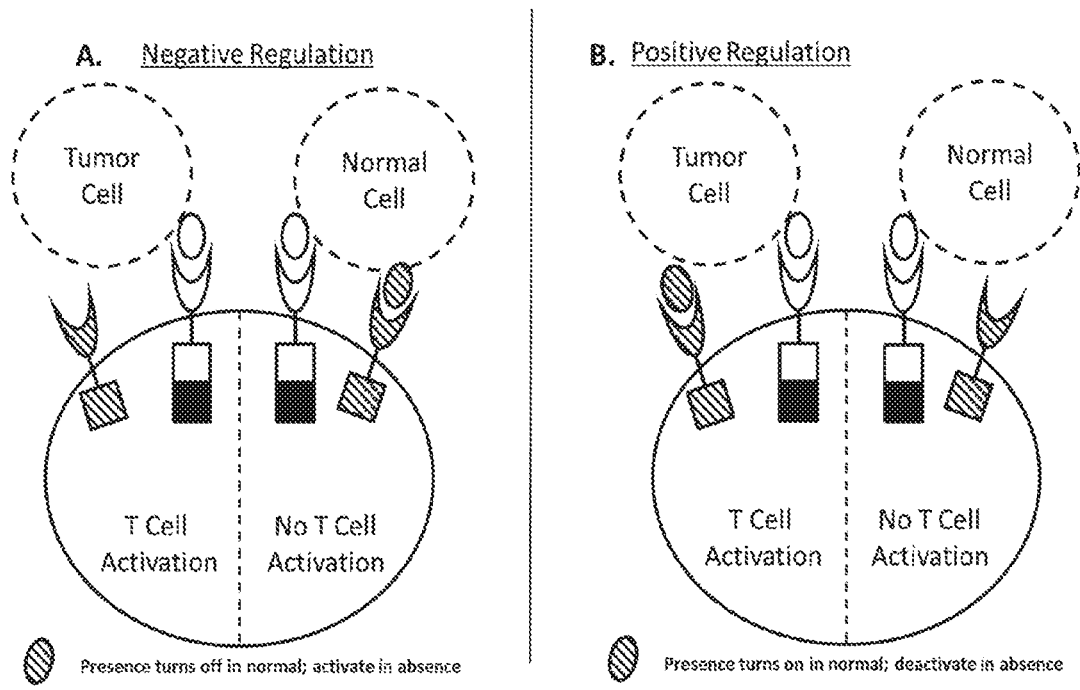
FIG. 17 depicts the positive and negative regulation of CAR engineered T cell activation. The absence or presence of a second stimulus can negatively (A) or positively (B) control T cell activation.
Figure 18:
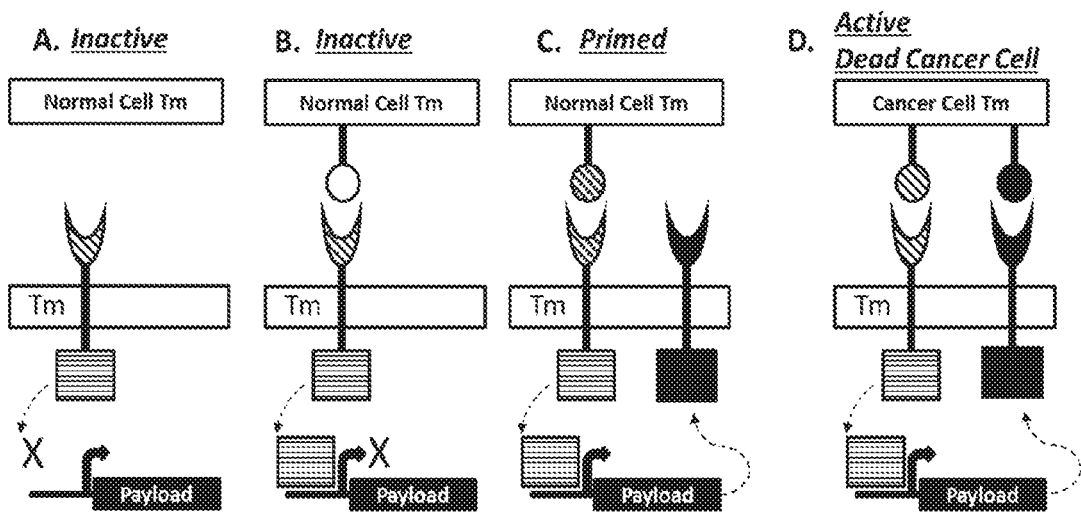
FIG. 18 shows schematic representation of gated activation of CAR engineered T cells. If a normal cell that has no stimulus (e.g., an antigen) (A) or an antigen that cannot bind to the trans-membrane effector module (B), or only an antigen that activates the trans-membrane effector module and primes the receiver T cell to express the second effector (C), the receiver T cell remains inactive. When both stimuli (e.g. two antigens) that bind the trans-membrane effector module and the primed effector, are present on the presenter cell (e.g. a cancer cell), the T cell is activated (D).

FIGS. 3 to 6 illustrate representative effector module embodiments comprising two payloads, i.e. two immunotherapeutic agents. In some aspects, more than two immunotherapeutic agents (payloads) may be included in the effector module under the regulation of the same SRE (e.g., the same DD). The two or more agents may be either directly linked to each other or separated (FIG. 3). The SRE may be positioned at the N-terminus of the construct, or the C-terminus of the construct, or in the internal location.

In some aspects, the two or more immunotherapeutic agents may be the same type such as two antibodies, or different types such as a CAR construct and a cytokine IL12. Biocircuits and components utilizing such effector molecules are given in FIGS. 7-12.

As used herein a "payload" or "target payload" is defined as any protein or nucleic acid whose function is to be altered. Payloads may include any coding or non-coding gene or any protein or fragment thereof, or fusion constructs, or antibodies.

Payloads are often associated with one or more SREs (e.g., DDs) and may be encoded alone or in combination with one or more DD in a polynucleotide of the invention. Payloads themselves may be altered (at the protein or nucleic acid level) thereby providing for an added layer of tenability of the effector module. For example, payloads may be engineered or designed to contain mutations, single or multiple, which affect the stability of the payload or its susceptibility to degradation, cleavage or trafficking. The combination of a DD which can have a spectrum of responses to a stimulus with a payload which is altered to exhibit a variety of responses or gradations of output signals, e.g., expression levels, produce biocircuits which are superior to those in the art. For example, mutations or substitutional designs such as those created for IL12 in WO2016048903 (specifically in Example 1 therein), the contents of which are incorporated herein by reference in their entirety, may be used in any protein payload in conjunction with a DD of the present invention to create dual tunable biocircuits. The ability to independently tune both the DD and the payload greatly increases the scope of uses of the effector modules of the present invention.

Effector modules may be designed to include one or more payloads, one or more DDs, one or more cleavage sites, one or more signal sequences, one or more tags, one or more targeting peptides, and one or more additional features including the presence or absence of one or more linkers. Representative effector module embodiments of the invention are illustrated in FIGS. 2-6. In some aspects, the DD can be positioned at the N-terminal end, or the C-terminal end, or internal of the effector module construct. Different components of an effector module such as DDs, payloads and additional features are organized linearly in one construct, or are separately constructed in separate constructs.

Additionally, effector modules of the present invention may further comprise other regulatory moieties such as inducible promoters, enhancer sequences, microRNA sites, and/or microRNA targeting sites that provide flexibility on controlling the activity of the payload. The payloads of the present invention may be any natural proteins and their variants, or fusion polypeptides, antibodies and variants thereof, transgenes and therapeutic agents.

The stimulus of the biocircuit system may be, but is not limited to, a ligand, a small molecule, an environmental signal (e.g., pH, temperature, light and subcellular location), a peptide or a metabolite. In one aspect of the present invention, the stimulus is a hPDE5 DD binding ligand including Sildenafil and Vardenafil.

Polypeptides of DDs, biocircuit systems and effector modules comprising such DDs and payload constructs, other components, polynucleotides encoding these polypeptides and variants thereof, vectors comprising these polynucleotides, are provided in the present invention. The vector may be a plasmid or a viral vector including but not limited to a lentiviral vector, a retroviral vector, a recombinant AAV vector and oncolytic viral vector.

The position of the payload with respect to the DD, within the SRE may be varied to achieve optimal DD regulation. In some embodiments, the payload may be fused to the N terminus of the DD. In another embodiment, the payload may be fused to the C terminus of the DDs. An optional start codon nucleotide sequence encoding for methionine may be added to the DD and/or payload.

In some embodiments, more than one biocircuit system may be used in combination to control various protein functions in the same cell or organism, each of which uses different DD and ligand pair and can be regulated separately.

In some embodiments, biocircuits of the invention may be modified to reduce their immunogenicity. Immunogenicity is the result of a complex series of responses to a substance that is perceived as foreign and may include the production of neutralizing and non-neutralizing antibodies, formation of immune complexes, complement activation, mast cell activation, inflammation, hypersensitivity responses, and anaphylaxis. Several factors can contribute to protein immunogenicity, including, but not limited to protein sequence, route and frequency of administration and patient population. In a preferred embodiment, protein engineering may be used to reduce the immunogenicity of the compositions of the invention. In some embodiments, modifications to reduce immunogenicity may include those that reduce binding of the processed peptides derived from the sequence of the compositions of the invention, to the MHC proteins. For example, amino acid may be modified such that virtually none or a minimal of number of immune epitopes predicted to bind to any prevalent MHC alleles are present in the compositions of the invention. Several methods to identify MHC binding epitopes of known protein sequences are known in the art and may be used to score epitopes in the compositions of the present invention. Such methods are disclosed in US Patent Publication No. US20020119492, US200402303 80, and US20060148009; the contents of each of which are incorporated by reference in their entirety.

Epitope identification and subsequent sequence modification may be applied to reduce immunogenicity. The identification of immunogenic epitopes may be achieved either physically or computationally. Physical methods of epitope identification may include, for example, mass spectrometry and tissue culture/cellular techniques. Computational approaches that utilize information related to antigen processing, loading and display, structural and/or proteomic data for identifying peptides that may result from antigen processing, and that are likely to have good binding characteristics in the groove of the MHC may also be utilized. One or more mutations may be introduced into the biocircuits of the invention to render the identified epitope less or non-immunogenic, while maintaining functionality.

In some embodiments, protein modifications engineered into the structure of the compositions of the invention to interfere with antigen processing and peptide loading such as glycosylation and PEGylation, may also be useful in the present invention. Compositions of the invention may also be engineered to include non-classical amino acid sidechains. Any of the methods discussed in International Patent Publication No. WO2005051975 for reducing immunogenicity may be useful in the present invention (the contents of which are incorporated by reference in their entirety).

In one embodiment, patients may also be stratified according to the immunogenic peptides presented by their immune cells and may be utilized as a parameter to determine patient cohorts that may therapeutically benefit from the compositions of the invention.

In some embodiments, reduced immunogenicity may be achieved by limiting immunoproteasome processing. The proteasome is an important cellular protease that is found in two forms: the constitutive proteasome, which is expressed in all cell types and which contains catalytic subunits and the immunoproteasome that is expressed in cells of the hematopoietic lineage, and which contains different active subunits termed low molecular weight proteins (LMP) namely LMP-2, LMP-7 and LMP-10. Immunoproteasomes exhibit altered peptidase activities and cleavage site preferences that result in more efficient liberation of many MHC class I epitopes. A well described function of the immunoproteasome is to generate peptides with hydrophobic C terminus that can be processed to fit in the groove of MHC class I molecules. Deol P et al. have shown that immunoproteasomes may lead to a frequent cleavage of specific peptide bonds and thereby to a faster appearance of a certain peptide on the surface of the antigen presenting cells; and enhanced peptide quantities (Deol P et al. (2007) *J Immunol* 178 (12) 7557-7562; the contents of which are incorporated herein reference in its entirety). This study indicates that reduced immunoproteasome processing may be accompanied by reduced immunogenicity. In some embodiments, immunogenicity of the compositions of the invention may be reduced by modifying the sequence encoding the compositions of the invention to prevent immunoproteasome processing. Biocircuits of the present invention may also be combined with immunoproteasome-selective inhibitors to achieve the same effects. Examples of inhibitors useful in the present invention include UK-101 (B1i selective compound), IPSI-001, ONX 0914 (PR-957), and PR-924 (IPSI).

In some embodiments, effector modules of the present invention may include one or more degrons to tune expression. As used herein, a "degron" refers to a minimal sequence within a protein that is sufficient for the recognition and the degradation by the proteolytic system. An important property of degrons is that they are transferrable, that is, appending a degron to a sequence confers degradation upon the sequence. In some embodiments, the degron may be appended to the destabilizing domains, the payload or both. Incorporation of the degron within the effector module of the invention, confers additional protein instability to the effector module and may be used to reduce basal expression. In some embodiments, the degron may be an N-degron, a phospho degron, a heat inducible degron, a photosensitive degron, an oxygen dependent degron. As a non-limiting example, the degron may be an Ornithine decarboxylase degron as described by Takeuchi et al.

(Takeuchi J et al. (2008). Biochem J. 2008 Mar. 1; 410(2): 401-7; the contents of which are incorporated by reference in their entirety). Other examples of degrons useful in the present invention include degrons described in International patent publication Nos. WO2017004022, WO2016210343, and WO2011062962; the contents of each of which are incorporated by reference in their entirety.

In some embodiments, the effector modules of the present invention may include degrons at their C termini. The degrons may comprise -GG, -RG, -KG, -QG, -WG, -PG, and -AG as the penultimate and the ultimate amino acids of the SREs. Furthermore, certain −2 amino acids (D, E, V, I and L) may be more enriched in the C terminus of the of the effector modules. Other degrons include, but are not limited, to RxxG motif, wherein x is any amino acid, C-terminal twin glutamic acid (EE) motif, and motifs that comprise an arginine at the −3 positions. Degrons may also be selected from the R-3 motif, G-end, R at −3, A-end, A at −2, V at −2 positions. Any of the degrons described in Koren et al., 2018, Cell 173, 1-14, may be useful in the present invention (the contents of which are incorporated by reference in their entirety). In some aspects, the expression of the effector module may be tuned by altering its overall amino acid composition. In some aspects, the amino acid composition of the effector module may be tuned to reduce basal expression. In some embodiments, basal expression may be tuned by increasing the number of bulky aromatic residues such as tryptophan (W), phenylalanine (F), and tyrosine (Y) in the effector module. Such bulky amino acids are known to reduce protein stability. In some embodiments, the amino acid composition of the SREs may be enriched with acidic residues such as, but not limited to, aspartic acid (D) and glutamic acid (E), and positively charged lysine (K), if an increase in the basal expression of the SRE is desired.

In some embodiments, the endoplasmic reticulum associated degradation (ERAD) pathway may be used to optimize degradation of the payloads described herein e.g. secreted and membrane cargos. In one embodiment, the effector modules of the invention may be directed to the ER E3 ligases by using adaptor proteins or protein domains. The endoplasmic reticulum is endowed with a specialized machinery to ensure proteins deployed to the distal secretory pathway are correctly folded and assembled into native oligomeric complexes. Proteins failing to meet this conformational standard are degraded by the ERAD pathway, a process through which folding defective proteins are selected and ultimately degraded by the ubiquitin proteasome system. ERAD proceeds through four main steps involving substrate selection, dislocation across the ER membrane, covalent conjugation with polyubiquitin, and proteasome degradation. Any of these steps may be modulated to optimize the degradation of the payloads and the effector modules described herein. Protein adaptors within the ER membrane, link substrate recognition to the ERAD machinery (herein referred to as the "dislocon"), which causes the dislocation of the proteins from the ER. Non-limiting examples of protein adaptors that may be used to optimize ERAD pathway degradation include, but are not limited to SEL1L (an adaptor that links glycan recognition to the dislocon), Erlins (intermembrane substrate adaptors), Insigs (client specific adaptors), F-Box proteins (act as adaptors for dislocated glycoproteins in the cytoplasm) and viral-encoded adaptors.

According to the present invention, novel destabilizing domains derived from human hPDE5 (cGMP-specific phosphodiesterase type 5) protein are provided. The destabilizing mutants are derived from the human PDE5 protein, comprising the amino acid sequence of SEQ ID NO. 1 (encoded by the nucleic acid sequence of SEQ ID NO: 2). The hPDE5 DD mutant may also comprise more than one mutation in the catalytic domain of human PDE5 of SEQ ID NO. 3 (encoded by nucleic acid sequence of SEQ ID NO. 339), e.g., two, three, four, five or more mutations. These hPDE5 DDs can bind to Sildenafil and/or Vardenafil and be stabilized.

Destabilizing Domains (DDs)

As used herein, the term "destabilizing domains (DDs)" refers to protein domains that are unstable and degraded in the absence of ligand, but whose stability is rescued by binding to a high affinity cell-permeable ligand. Destabilizing domains (DDs) can be appended to a target protein of interest (POI) and can convey its destabilizing property to the protein of interest, causing protein degradation. The presence, absence or an amount of a small molecule ligand that binds to or interacts with the DD, can, upon such binding or interaction modulate the stability of the payload(s) and consequently the function of the payload. A protein domain with destabilizing property (e.g. a DD) is used in conjunction with a cell-permeable ligand to regulate any protein of interest when it is fused with the destabilizing domain. DDs render the attached protein of interest unstable in the absence of a DD-binding ligand such that the protein is rapidly degraded by the ubiquitin-proteasome system of the cell. However, when a specific small molecule ligand binds its intended DD as a ligand binding partner, the instability is reversed and protein function is restored. The conditional nature of DD stability allows a rapid and non-perturbing switch from stable protein to unstable substrate for degradation. Moreover, its dependency on the concentration of its ligand further provides tunable control of degradation rates. Depending on the degree of binding and/or interaction the altered function of the payload may vary, hence providing a "tuning" of the payload function.

Due to its reversibility, specificity and the fast and easy regulation on protein level, the post-transcriptional tuning system provides a useful system for gene regulation. Furthermore, the regulation may be dose-dependent, thereby altering the protein-turnover rate to transform a short-lived or no detectable protein into a protein that functions for a precisely controlled period of time (Iwamoto et al., *Chem. Biol.* 2010, 17: 981-988).

In some embodiments, the desired characteristics of the DDs may include, but are not limited to, low protein levels in the absence of a ligand of the DD (i.e. low basal stability), large dynamic range, robust and predictable dose-response behavior, and rapid kinetics of degradation. Candidate DDs that bind to a desired ligand but not endogenous molecules may be preferred.

Candidate destabilizing domain sequence identified from protein domains of known wildtype proteins (as a template) may be mutated to generate libraries of mutants based on the template candidate domain sequence. Mutagenesis strategies used to generate DD libraries may include site-directed mutagenesis e.g. by using structure guided information, or random mutagenesis e.g. using error-prone PCR, or a combination of both. In some embodiments, destabilizing domains identified using random mutagenesis may be used to identify structural properties of the candidate DDs that may be required for destabilization, which may then be used to further generate libraries of mutations using site directed mutagenesis.

In some embodiments, novel DDs may be identified by mutating one or more amino acids in the candidate destabilizing domain to an amino acid that is vicinal to the mutation site. As used herein a vicinal amino acid refers to an amino acid that is located 1, 2, 3, 4, 5 or more amino acids upstream or downstream of the mutation site in the linear sequence and/or the crystal structure of the candidate destabilizing domain. In some embodiments, the vicinal amino acid may be a conserved amino acid (with similar physicochemical properties as the amino acid at the mutation site), a semi-conserved amino acid (e.g. negatively to positively charge amino acid) or a non-conserved amino acid (with different physicochemical properties than the amino acid at the mutation site).

In some embodiments, DD mutant libraries may be screened for mutations with altered, preferably higher binding affinity to the ligand, as compared to the wild type protein. DD libraries may also be screened using two or more ligands and DD mutations that are stabilized by some ligands but not others may be preferentially selected. DD mutations that bind preferentially to the ligand compared to a naturally occurring protein may also be selected. Such methods may be used to optimize ligand selection and ligand binding affinity of the DD. Additionally, such approaches can be used to minimize deleterious effects caused by off-target ligand binding.

In some embodiments, suitable DDs may be identified by screening mutant libraries using barcodes. Such methods may be used to detect, identify and quantify individual mutant clones within the heterogeneous mutant library. Each DD mutant within the library may have distinct barcode sequences (with respect to each other). In other instances, the polynucleotides can also have different barcode sequences with respect to 2, 3, 4, 5, 6, 7, 8, 9, 10 or more nucleic acid bases. Each DD mutant within the library may also comprise a plurality of barcode sequences. When used in plurality barcodes may be used such that each barcode is unique to any other barcode. Alternatively, each barcode used may not be unique, but the combination of barcodes used may create a unique sequence that can be individually tracked. The barcode sequence may be placed upstream of the SRE, downstream of the SRE, or in some instances may be placed within the SRE. DD mutants may be identified by barcodes using sequencing approaches such as Sanger sequencing, and next generation sequencing, but also by polymerase chain reaction and quantitative polymerase chain reaction. In some embodiments, polymerase chain reaction primers that amplify a different size product for each barcode may be used to identify each barcode on an agarose gel. In other instances, each barcode may have a unique quantitative polymerase chain reaction probe sequence that enables targeted amplification of each barcode.

Inventors of the present invention investigated several human proteins and identified novel human DDs which can confer its instability features to the fused payload and facilitate the rapid degradation of the fusion polypeptide in the absence of its ligand but stabilize the fused payload in response to the binding to its ligand. Specifically, the new DDs are derived from human PDE5 protein.

Human PDE5 Mutants

In some embodiments, DDs of the invention may be derived from human cGMP-specific phosphodiesterase type 5 (PDE5); gene name: PDE5A (herein referred to as "hPDE5"). hPDE5 (phosphodiesterase 5) is a member of the 3,5'-cyclic nucleotide phosphodiesterase family which degrades/hydrolyzes cyclic GMP (cGMP) into its inactive form, GMP, and regulates cGMP signaling. The cGMP/PDE 5 signaling contributes to the development of hypertension in the vasculature, the central nervous system, and the kidney. hPDE5 is known to bind to small molecule such as Sildenafil, Vardenafil, Tadalafil, Avanafil, Lodenafil, Mirodenafil, Udenafil, Benzamidenafil, Dasantafil, Beminafil, SLx-2101, LAS 34179, UK-343,664, UK-357903, UK-371800, and BMS-341400. Sildenafil, Vardenafil, Avanafil, and Tadalafil are hPDE5 inhibitors clinically approved for the treatment of erectile dysfunction. In particular, the binding of these small molecules to hPDE5 occurs within the catalytic domain. In some embodiments, the DDs of the invention may be derived from the catalytic domain of hPDE5 (SEQ ID NO. 3) which includes of residues 535 to 860 of hPDE5 (SEQ ID NO. 1; GenBank Access NO. 076074.2) which may be stabilized by ligands such as small molecule inhibitors of hPDE5 e.g. Sildenafil and Vardenafil. As used herein the term "PDE5 WT" or "hPDE5 WT", refers to the human wildtype PDE5 protein sequence, which is defined as SEQ ID NO. 1, with the GenBank Access NO. 076074.2. In some embodiments, DDs of the present invention may be identified by utilizing a cocktail of hPDE5 inhibitors. In other instances, the suitable DDs may be identified by screening first with one hPDE5 inhibitor and subsequently screening with a second hPDE5 inhibitor.

In one embodiment, the hPDE5 derived DD may comprise the amino acid sequence of UniProt ID: O76074 (SEQ ID NO. 1) or a portion or a fragment thereof. In another embodiment, the hPDE5 derived DD may comprise the catalytic domain of UniProt ID: O76074, spanning from amino acid position 535 to position 860 (SEQ ID NO. 3); encoded by SEQ ID NO. 339. In addition to the catalytic domain, hPDE5 derived DDs may also comprise one or more GAF domains and/or the C terminal portion that extends beyond the catalytic domain. In some embodiment, the hPDE5 derived DD may be identified by testing constructs generated by truncating the 5' and/or the 3' end of hPDE5. In one embodiment, the hPDE5 derived DD may be truncated and the smallest hPDE5 based DD may be identified. In another embodiment, the hPDE5 derived DD may include amino acids from position 535 to 836 of SEQ ID NO. 1 which removes the C terminal helix. In another embodiment, the hPDE5 derived DD may consist of amino acids from position 567 to 860 of UniProt ID: O76074 (SEQ ID NO. 1), or position 590 to 860 of UniProt ID: O76074 (SEQ ID NO. 1), which removes a portion of the N terminal domain. In another embodiment, the hPDE5 derived DD may consist of amino acids from position 590 to 836 of UniProt ID: 076074 (SEQ ID NO. 1), which removes a portion of the N terminal domain and the C terminal helix. The DD may include amino acids from position 535 to position 875 of UniProt ID: O76074 (SEQ ID NO. 1). In another embodiment, the hPDE5 derived DD may consist of amino acids from position 466 to 875 of UniProt ID: O76074 (SEQ ID NO. 1) or position 420 to 875 of UniProt ID: O76074 (SEQ ID NO. 1).

According to the present invention, several hPDE5 destabilizing mutations were discovered by site directed mutagenesis of the catalytic domain of wildtype human PDE5 using site directed mutagenesis. The destabilization of the mutants in the absence of its binding ligands is tested. Binding to hPDE5 ligands, Sildenafil, Tadalafil and Vardenafil to human PDE5 was tested and ligand dependent stabilization was characterized. Based on the structural analysis of hPDE5 bound to Sildenafil, several residues were selected for mutagenesis. In some embodiments one or more of the residues described herein may be mutagenized to obtain hPDE5 derived DDs. The tryptophan at position 853 of SEQ ID NO.1 may be mutated to phenylalanine to induce hydrophobic packing near binding site, while maintaining pi bond with the nearby tryptophan at position 772. The isoleucine at position 821 may be mutated to valine or alanine, which results in hydrophobic packing near binding site. The tyrosine at position 829 may be mutated to isoleucine, valine or alanine, which results in hydrophobic packing near binding site. The aspartate at position 656 may be mutated to asparagine or leucine to break up the charge and the salt bridge on loop/helix. The tyrosine at position 728 may be mutated to phenylalanine or leucine to break the salt bridges at position 732 and to affect hydrophobic packing. Alternatively, the arginine at position 732 may be mutated to lysine or leucine to generate the inverse of the effects of mutating tyrosine at position 728. The methionine at position 625 may be mutated to leucine or isoleucine to alter packing in away from the binding site. In some embodiments, destabilizing mutations that do not affect ligand binding may be preferentially selected.

In some embodiments, new destabilizing domains of the present invention are derived from the catalytic domain of human PDE5 protein comprising the amino acid sequence of SEQ ID NO. 3. In some aspects, the destabilizing mutant domain may comprise one, two, three, four, five or more mutations such as, but not limited to, M625I, D656L, Y728L, R732L, F736A, F787A, 1821A, Y829A and W853F. The DDs of the invention may further include additional mutations e.g. E535D, E536G, Q541R, K555R, S560G, F559L, F561L, F564L, F564S, S766F, V585A, N587S, K591E, I599V, K604E, K608E, N609H, K630R, K633E, N636S, I648V, N661S, S663P, L675P, Y676D, Y676N, C677R, H678R, D687A, T711A, T712S, D724N, L738H, N742S, F744L, L746S, F755L, A762S, D764V, D764N, D764G, K795E, L797F, I799T, L804P, T802P, S815C, M816A, M816T, I824T, C839S, F840S, and K852E. In some embodiments, any of the mutation sites disclosed herein may be mutated to any of the known amino acids such as Histidine, Alanine, Isoleucine, Arginine, Leucine, Aspartic acid, Lysine, Cysteine, Methionine, Glutamic acid, Phenylalanine, Glutamine, Threonine, Glycine, Tryptophan, Proline, Valine, Serine, Tyrosine, Asparagine, Selenocysteine, Pyrrolysine. In some embodiments, DDs of the present invention may be stabilized by ligands such as Sildenafil, Vardenafil, Tadalafil, Avanafil, Lodenafil, Mirodenafil, Udenafil, Benzamidenafil, Dasantafil, and Beminafil.

The amino acid sequences of the destabilizing domains encompassed in the invention have at least about 40%, 50 or 60% identity, further at least about 70% identity, preferably at least about 75% or 80% identity, more preferably at least about 85%, 86%, 87%, 88%, 89% or 90% identity, and further preferably at least about 91%, 92%, 93%, 94%, 95%, 96%, 97%, 98% or 99% identity to the amino acid sequence set forth therein. Percent identity may be determined, for example, by comparing sequence information using the advanced BLAST computer program, including version Magic-BLAST 1.2.0, available from the National Institutes of Health. The BLAST program is based on the alignment method discussed in Karl and Altschul (1990) Proc. Natl. Acad. Sci USA, 87:2264-68 (the contents of which are incorporated by reference in their entirety).

Several hPDE5 destabilizing mutants were identified and are provided in Table 1. The position of the mutated amino acids listed in Table 1 is relative to the full length hPDE5 of SEQ ID NO. 1. The domains described in Table 1 include the catalytic domain of hPDE5 (e.g., 535-860 of SEQ ID NO. 1). In some embodiments, the hPDE5 DDs described in Table 1 may include a methionine at the N terminal of the catalytic domain of hPDE5, i.e. amino acid 535-860 of PDE5 WT. In Table 1, the mutated amino acids are in bold and underlined.

TABLE 1 hPDE5 DDs

| hPDE5 mutant description | Amino Acid Sequence | AA SEQ ID NO | NA SEQ ID NO |
|---|---|---|---|
| hPDE5 (Amino acid 535-860 of WT, W853F) | EETRELQSLAAAVVPSAQTLKITDFSFSDFELSDLETALCTI<br>RMFTDLNLVQNFQMKHEVLCRWILSVKKNYRKNVAYHN<br>WRHAFNTAQCMFAALKAGKIQNKLTDLEILALLIAALSH<br>DLDHRGVNNSYIQRSEHPLAQLYCHSIMEHHHFDQCLMIL<br>NSPGNQILSGLSIEEYKTTLKIIKQAILATDLALYIKRRGEFF<br>ELIRKNQFNLEDPHQKELFLAMLMTACDLSAITKPWPIQQ<br>RIAELVATEFFDQGDRERKELNIEPTDLMNREKKNKIPSM<br>QVGFIDAICLQLYEALTHVSEDCFPLLDGCRKNRQKFQAL<br>AEQQ | 5 | 350 |
| hPDE5 (Amino acid 535-860 of WT, I821A) | EETRELQSLAAAVVPSAQTLKITDFSFSDFELSDLETALCTI<br>RMFTDLNLVQNFQMKHEVLCRWILSVKKNYRKNVAYHN<br>WRHAFNTAQCMFAALKAGKIQNKLTDLEILALLTAALSH<br>DLDHRGVNNSYIQRSEHPLAQLYCHSIMEHHHFDQCLMIL<br>NSPGNQILSGLSIEEYKTTLKIIKQAILATDLALYIKRRGEFF<br>ELIRKNQFNLEDPHQKELFLAMLMTACDLSAITKPWPIQQ<br>RIAELVATEFFDQGDRERKELNIEPTDLMNREKKNKIPSM<br>QVGFADAICLQLYEALTHVSEDCFPLLDGCRKNRQKWQA<br>LAEQQ | 6 | 351 |
| hPDE5 (Amino acid 535-860 of WT, Y829A) | EETRELQSLAAAVVPSAQTLKITDFSFSDFELSDLETALCTI<br>RMFTDLNLVQNFQMKHEVLCRWILSVKKNYRKNVAYHN<br>WRHAFNTAQCMFAALKAGKIQNKLTDLEILALLTAALSH<br>DLDHRGVNNSYIQRSEHPLAQLYCHSIMEHHHFDQCLMIL<br>NSPGNQILSGLSIEEYKTTLKIIKQAILATDLALYIKRRGEFF<br>ELIRKNQFNLEDPHQKELFLAMLMTACDLSAITKPWPIQQ<br>RIAELVATEFFDQGDRERKELNIEPTDLMNREKKNKIPSM<br>QVGFIDAICLQLAEALTHVSEDCFPLLDGCRKNRQKWQA<br>LAEQQ | 7 | 352 |

TABLE 1-continued hPDE5 DDs

| hPDE5 mutant description | Amino Acid Sequence | AA SEQ ID NO | NA SEQ ID NO |
|---|---|---|---|
| hPDE5 (Amino acid 535-860 of WT, F787A) | EETRELQSLAAAVVPSAQTLKITDFSFSDFELSDLETALCTI RMFTDLNLVQNFQMKHEVLCRWILSVKKNYRKNVAYHN WRHAFNTAQCMFAALKAGKIQNKLTDLEILALLTAALSH DLDHRGVNNSYIQRSEHPLAQLYCHSIMEHHHFDQCLMIL NSPGNQILSGLSIEEYKTTLKIIKQAILATDLALYIKRRGEFF ELIRKNQFNLEDPHQKELFLAMLMTACDLSAITKPWPIQQ RIAELVATEFADQGDRERKELNIEPTDLMNREKKNKIPSM QVGFIDAICLQLYEALTHVSEDCFPLLDGCRKNRQKWQA LAEQQ | 8 | 353 |
| hPDE5 (Amino acid 535-860 of WT, F736A) | EETRELQSLAAAVVPSAQTLKITDFSFSDFELSDLETALCTI RMFTDLNLVQNFQMKHEVLCRWILSVKKNYRKNVAYHN WRHAFNTAQCMFAALKAGKIQNKLTDLEILALLTAALSH DLDHRGVNNSYIQRSEHPLAQLYCHSIMEHHHFDQCLMIL NSPGNQILSGLSIEEYKTTLKIIKQAILATDLALYIKRRGEF AELIRKNQFNLEDPHQKELFLAMLMTACDLSAITKPWPIQ QRIAELVATEFFDQGDRERKELNIEPTDLMNREKKNKIPS MQVGFIDAICLQLYEALTHVSEDCFPLLDGCRKNRQKWQ ALAEQQ | 9 | 354; 355 |
| hPDE5 (Amino acid 535-860 of WT, D656L) | EETRELQSLAAAVVPSAQTLKITDFSFSDFELSDLETALCTI RMFTDLNLVQNFQMKHEVLCRWILSVKKNYRKNVAYHN WRHAFNTAQCMFAALKAGKIQNKLTDLEILALLTAALSH DLLHRGVNNSYIQRSEHPLAQLYCHSIMEHHHFDQCLMIL NSPGNQILSGLSIEEYKTTLKIIKQAILATDLALYIKRRGEFF ELIRKNQFNLEDPHQKELFLAMLMTACDLSAITKPWPIQQ RIAELVATEFFDQGDRERKELNIEPTDLMNREKKNKIPSM QVGFIDAICLQLYEALTHVSEDCFPLLDGCRKNRQKWQA LAEQQ | 10 | 356 |
| hPDE5 (Amino acid 535-860 of WT, Y728L) | EETRELQSLAAAVVPSAQTLKITDFSFSDFELSDLETALCTI RMFTDLNLVQNFQMKHEVLCRWILSVKKNYRKNVAYHN WRHAFNTAQCMFAALKAGKIQNKLTDLEILALLIAALSH DLDHRGVNNSYIQRSEHPLAQLYCHSIMEHHHFDQCLMIL NSPGNQILSGLSIEEYKTTLKIIKQAILATDLALLIKRRGEFF ELIRKNQFNLEDPHQKELFLAMLMTACDLSAITKPWPIQQ RIAELVATEFFDQGDRERKELNIEPTDLMNREKKNKIPSM QVGFIDAICLQLYEALTHVSEDCFPLLDGCRKNRQKWQA LAEQQ | 11 | 357 |
| hPDE5 (Amino acid 535-860 of WT, R732L) | EETRELQSLAAAVVPSAQTLKITDFSFSDFELSDLETALCTI RMFTDLNLVQNFQMKHEVLCRWILSVKKNYRKNVAYHN WRHAFNTAQCMFAALKAGKIQNKLTDLEILALLIAALSH DLDHRGVNNSYIQRSEHPLAQLYCHSIMEHHHFDQCLMIL NSPGNQILSGLSIEEYKTTLKIIKQAILATDLALYIKRLGEFF ELIRKNQFNLEDPHQKELFLAMLMTACDLSAITKPWPIQQ RIAELVATEFFDQGDRERKELNIEPTDLMNREKKNKIPSM QVGFIDAICLQLYEALTHVSEDCFPLLDGCRKNRQKWQA LAEQQ | 12 | 358; 359 |
| hPDE5 (Amino acid 535-860 of WT, M625I) | EETRELQSLAAAVVPSAQTLKITDFSFSDFELSDLETALCTI RMFTDLNLVQNFQMKHEVLCRWILSVKKNYRKNVAYHN WRHAFNTAQCIFAALKAGKIQNKLTDLEILALLIAALSHD LDHRGVNNSYIQRSEHPLAQLYCHSIMEHHHFDQCLMILN SPGNQILSGLSIEEYKTTLKIIKQAILATDLALYIKRRGEFFE LIRKNQFNLEDPHQKELFLAMLMTACDLSAITKPWPIQQRI AELVATEFFDQGDRERKELNIEPTDLMNREKKNKIPSMQV GFIDAICLQLYEALTHVSEDCFPLLDGCRKNRQKWQALAE QQ | 13 | 360 |
| Methionine; hPDE5 (Amino acid 535-860 of WT; W853F) | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKF QALAEQQ | 340 | 14 |

TABLE 1-continued hPDE5 DDs

| hPDE5 mutant description | Amino Acid Sequence | AA SEQ ID NO | NA SEQ ID NO |
|---|---|---|---|
| Methionine; hPDE5 (Amino acid 535-860 of WT, I821A) | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFADAICLQLYEALTHVSEDCFPLLDGCRKNRQK WQALAEQQ | 341 | 15 |
| Methionine; hPDE5 (Amino acid 535-860 of WT, Y829A) | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFIDAICLQLAEALTHVSEDCFPLLDGCRKNRQKW QALAEQQ | 342 | 16 |
| Methionine; hPDE5 (Amino acid 535-860 of WT, F787A) | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFADQGDRERKELNIEPTDLMNREKKNKI PSMQVGFIDAICLQLYEALTHVSEDCFPLLDGCRKNRQKW QALAEQQ | 343 | 17 |
| Methionine; hPDE5 (Amino acid 535-860 of WT, F736A) | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFAELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKW QALAEQQ | 344 | 18 |
| Methionine; hPDE5 (Amino acid 535-860 of WT, D656L) | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLLHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKW QALAEQQ | 345 | 19 |
| Methionine; hPDE5 (Amino acid 535-860 of WT, Y728L) | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALLIKRRG EFFELIRKNQFNLEDPHQKELFLAMLMTACDLSAITKPWPI QQRIAELVATEFFDQGDRERKELNIEPTDLMNREKKNKIPS MQVGFIDAICLQLYEALTHVSEDCFPLLDGCRKNRQKWQ ALAEQQ | 346 | 20 |
| Methionine; hPDE5 (Amino acid 535-860 of WT, R732L) | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRL GEFFELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKW QALAEQQ | 238 | 21 |

TABLE 1-continued hPDE5 DDs

| hPDE5 mutant description | Amino Acid Sequence | AA SEQ ID NO | NA SEQ ID NO |
| --- | --- | --- | --- |
| Methionine; hPDE5 (Amino acid 535-860 of WT, M625I) | MEETRELQSLAAAVVPSAQTLKITDFSFSDFELSDLETALC TIRMFTDLNLVQNFQMKHEVLCRWILSVKKNYRKNVAY HNWRHAFNTAQCIFAALKAGKIQNKLTDLEILALLIAALS HDLDHRGVNNSYIQRSEHPLAQLYCHSIMEHHHFDQCLMI LNSPGNQILSGLSIEEYKTTLKIIKQAILATDLALYIKRRGEF FELIRKNQFNLEDPHQKELFLAMLMTACDLSAITKPWPIQ QRIAELVATEFFDQGDRERKELNIEPTDLMNREKKNKIPS MQVGFIDAICLQLYEALTHVSEDCFPLLDGCRKNRQKWQ ALAEQQ | 347 | 22 |
| hPDE5 (Amino acid 535-860 of WT, H653A) | EETRELQSLAAAVVPSAQTLKITDFSFSDFELSDLETALCTI RMFTDLNLVQNFQMKHEVLCRWILSVKKNYRKNVAYHN WRHAFNTAQCMFAALKAGKIQNKLTDLEILALLIAALSA DLDHRGVNNSYIQRSEHPLAQLYCHSIMEHHHFDQCLMIL NSPGNQILSGLSIEEYKTTLKIIKQAILATDLALYIKRRGEFF ELIRKNQFNLEDPHQKELFLAMLMTACDLSAITKPWPIQQ RIAELVATEFFDQGDRERKELNIEPTDLMNREKKNKIPSM QVGFIDAICLQLYEALTHVSEDCFPLLDGCRKNRQKWQA LAEQQ | 348 | 361 |
| hPDE5 (Amino acid 535-860 of WT, D764A) | EETRELQSLAAAVVPSAQTLKITDFSFSDFELSDLETALCTI RMFTDLNLVQNFQMKHEVLCRWILSVKKNYRKNVAYHN WRHAFNTAQCMFAALKAGKIQNKLTDLEILALLIAALSH DLDHRGVNNSYIQRSEHPLAQLYCHSIMEHHHFDQCLMIL NSPGNQILSGLSIEEYKTTLKIIKQAILATDLALYIKRRGEFF ELIRKNQFNLEDPHQKELFLAMLMTACALSAITKPWPIQQ RIAELVATEFFDQGDRERKELNIEPTDLMNREKKNKIPSM QVGFIDAICLQLYEALTHVSEDCFPLLDGCRKNRQKWQA LAEQQ | 349 | 362 |

In some embodiments, DDs derived from hPDE5 may include one, two, three, four, five, or more of the mutations described in the previous Table (Table 1).

In some embodiments, DDs derived from hPDE5 may further comprise one, two, three, four, five or more mutations to the catalytic domain of hPDE5 and may be selected from E535D, E536G, Q541R, K555R, S560G, F559L, F561L, F564L, F564S, S766F, V585A, N587S, K591E, I599V, K604E, K608E, N609H, K630R, K633E, N636S, I648V, N661S, S663P, L675P, Y676D, Y676N, C677R, H678R, D687A, T711A, T712S, D724N, L738H, N742S, F744L, L746S, F755L, A762S, D764V, D764N, D764G, K795E, L797F, I799T, L804P, T802P, S815C, M816A, M816T, I824T, C839S, F840S, and K852E (as listed in Table 2). The position of the mutated amino acid is with respect to the hPDE5 of SEQ ID NO. 1. In Table 2, the mutated amino acids are underlined and in bold. The position of the mutated amino acids listed in Table 2 is relative to the full length hPDE5 of SEQ ID NO.1

TABLE 2

Additional hPDE5 DDs

| hPDE5 mutant description | Amino Acid Sequence | AA SEQ ID NO |
| --- | --- | --- |
| hPDE5 (Amino acid 535-860 of WT, E535D) | DETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 23 |
| hPDE5 (Amino acid 535-860 of WT, E536G) | EGTRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 24 |

TABLE 2-continued

Additional hPDE5 DDs

| hPDE5 mutant description | Amino Acid Sequence | AA SEQ ID NO |
|---|---|---|
| hPDE5 (Amino acid 535-860 of WT, Q541R) | EETRELRSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 25 |
| hPDE5 (Amino acid 535-860 of WT, K555R) | EETRELQSLAAAVVPSAQTLRITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 26 |
| hPDE5 (Amino acid 535-860 of WT, F559L) | EETRELQSLAAAVVPSAQTLKITDLLSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 27 |
| hPDE5 (Amino acid 535-860 of WT, F561L) | EETRELQSLAAAVVPSAQTLKITDFSLSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 28 |
| hPDE5 (Amino acid 535-860 of WT, F564L) | EETRELQSLAAAVVPSAQTLKITDFSFSDLELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 29 |
| hPDE5 (Amino acid 535-860 of WT, F564S) | EETRELQSLAAAVVPSAQTLKITDFSFSDSELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 30 |
| hPDE5 (Amino acid 535-860 of WT, K591E) | EETRELQSLAAAVVPSAQTLKITDFSFSDFELSDLETALCTIRMFT DLNLVQNFQMEHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 31 |
| hPDE5 (Amino acid 535-860 of WT, N587S) | EETRELQSLAAAVVPSAQTLKITDFSFSDFELSDLETALCTIRMFT DLNLVQSFQMKHEVLCRWILSVKKNYRKNVAYHNWRHAFNTA QCMFAALKAGKIQNKLTDLEILALLIAALSHDLDHRGVNNSYIQ RSEHPLAQLYCHSIMEHHHFDQCLMILNSPGNQILSGLSIEEYKT TLKIIKQAILATDLALYIKRRGEFFELIRKNQFNLEDPHQKELFLA MLMTACDLSAITKPWPIQQRIAELVATEFFDQGDRERKELNIEPT DLMNREKKNKIPSMQVGFIDAICLQLYEALTHVSEDCFPLLDGC RKNRQKWQALAEQQ | 32 |

TABLE 2-continued

Additional hPDE5 DDs

| hPDE5 mutant description | Amino Acid Sequence | AA SEQ ID NO |
|---|---|---|
| hPDE5 (Amino acid 535-860 of WT, K604E) | EETRELQSLAAAVVPSAQTLKITDFSFSDFELSDLETALCTIRMFT DLNLVQNFQMKHEVLCRWILSVKENYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 33 |
| hPDE5 (Amino acid 535-860 of WT, K608E) | EETRELQSLAAAVVPSAQTLKITDFSFSDFELSDLETALCTIRMFT DLNLVQNFQMKHEVLCRWILSVKKNYRENVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 34 |
| hPDE5 (Amino acid 535-860 of WT, N609H) | EETRELQSLAAAVVPSAQTLKITDFSFSDFELSDLETALCTIRMFT DLNLVQNFQMKHEVLCRWILSVKKNYRKHVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 35 |
| hPDE5 (Amino acid 535-860 of WT, K630R) | EETRELQSLAAAVVPSAQTLKITDFSFSDFELSDLETALCTIRMFT DLNLVQNFQMKHEVLCRWILSVKKNYRKNVAYHNWRHAFNT AQCMFAALRAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 36 |
| hPDE5 (Amino acid 535-860 of WT, K633E) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGEIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 37 |
| hPDE5 (Amino acid 535-860 of WT, N636S) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQSKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 38 |
| hPDE5 (Amino acid 535-860 of WT, N661S) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVSNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 39 |
| hPDE5 (Amino acid 535-860 of WT, Y676D) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLDCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 40 |

TABLE 2-continued

Additional hPDE5 DDs

| hPDE5 mutant description | Amino Acid Sequence | AA SEQ ID NO |
|---|---|---|
| hPDE5 (Amino acid 535-860 of WT, Y676N) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLTAALSHDLDHRGVNNSYI<br>QRSEHPLAQLNCHSIMEHHHFDQCLMILNSPGNQILSGLSIEEYK<br>TTLKIIKQAILATDLALYIKRRGEFFELIRKNQFNLEDPHQKELFL<br>AMLMTACDLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 41 |
| hPDE5 (Amino acid 535-860 of WT, C677R) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLTAALSHDLDHRGVNNSYI<br>QRSEHPLAQLYRHSIMEHHHFDQCLMILNSPGNQILSGLSIEEYK<br>TTLKIIKQAILATDLALYIKRRGEFFELIRKNQFNLEDPHQKELFL<br>AMLMTACDLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 42 |
| hPDE5 (Amino acid 535-860 of WT, H678R) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLTAALSHDLDHRGVNNSYI<br>QRSEHPLAQLYCRSIMEHHHFDQCLMILNSPGNQILSGLSIEEYK<br>TTLKIIKQAILATDLALYIKRRGEFFELIRKNQFNLEDPHQKELFL<br>AMLMTACDLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 43 |
| hPDE5 (Amino acid 535-860 of WT, D687A) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLTAALSHDLDHRGVNNSYI<br>QRSEHPLAQLYCHSIMEHHHFAQCLMILNSPGNQILSGLSIEEYK<br>TTLKIIKQAILATDLALYIKRRGEFFELIRKNQFNLEDPHQKELFL<br>AMLMTACDLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 44 |
| hPDE5 (Amino acid 535-860 of WT, T712S) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLTAALSHDLDHRGVNNSYI<br>QRSEHPLAQLYCHSIMEHHHFDQCLMILNSPGNQILSGLSIEEYK<br>TSLKIIKQAILATDLALYIKRRGEFFELIRKNQFNLEDPHQKELFL<br>AMLMTACDLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 45 |
| hPDE5 (Amino acid 535-860 of WT, D724N) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLTAALSHDLDHRGVNNSYI<br>QRSEHPLAQLYCHSIMEHHHFDQCLMILNSPGNQILSGLSIEEYK<br>TTLKIIKQAILATNLALYIKRRGEFFELIRKNQFNLEDPHQKELFL<br>AMLMTACDLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 46 |
| hPDE5 (Amino acid 535-860 of WT, D724G) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLTAALSHDLDHRGVNNSYI<br>QRSEHPLAQLYCHSIMEHHHFDQCLMILNSPGNQILSGLSIEEYK<br>TTLKIIKQAILATGLALYIKRRGEFFELIRKNQFNLEDPHQKELFL<br>AMLMTACDLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 47 |
| hPDE5 (Amino acid 535-860 of WT, L738H) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLTAALSHDLDHRGVNNSYI<br>QRSEHPLAQLYCHSIMEHHHFDQCLMILNSPGNQILSGLSIEEYK<br>TTLKIIKQAILATDLALYIKRRGEFFEHIRKNQFNLEDPHQKELFL<br>AMLMTACDLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 48 |

TABLE 2-continued

Additional hPDE5 DDs

| hPDE5 mutant description | Amino Acid Sequence | AA SEQ ID NO |
|---|---|---|
| hPDE5 (Amino acid 535-860 of WT, N742S) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLIAALSHDLDHRGVNNSYI<br>QRSEHPLAQLYCHSIMEHHHFDQCLMILNSPGNQILSGLSIEEYK<br>TTLKIIKQAILATDLALYIKRRGEFFELIRKSQFNLEDPHQKELFL<br>AMLMTACDLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 49 |
| hPDE5 (Amino acid 535-860 of WT, A762S) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLIAALSHDLDHRGVNNSYI<br>QRSEHPLAQLYCHSIMEHHHFDQCLMILNSPGNQILSGLSIEEYK<br>TTLKIIKQAILATDLALYIKRRGEFFELIRKNQFNLEDPHQKELFL<br>AMLMTSCDLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 50 |
| hPDE5 (Amino acid 535-860 of WT, D764N) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLIAALSHDLDHRGVNNSYI<br>QRSEHPLAQLYCHSIMEHHHFDQCLMILNSPGNQILSGLSIEEYK<br>TTLKIIKQAILATDLALYIKRRGEFFELIRKNQFNLEDPHQKELFL<br>AMLMTACNLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 51 |
| hPDE5 (Amino acid 535-860 of WT, D764G) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLIAALSHDLDHRGVNNSYI<br>QRSEHPLAQLYCHSIMEHHHFDQCLMILNSPGNQILSGLSIEEYK<br>TTLKIIKQAILATDLALYIKRRGEFFELIRKNQFNLEDPHQKELFL<br>AMLMTACGLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 52 |
| hPDE5 (Amino acid 535-860 of WT, D764V) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLIAALSHDLDHRGVNNSYI<br>QRSEHPLAQLYCHSIMEHHHFDQCLMILNSPGNQILSGLSIEEYK<br>TTLKIIKQAILATDLALYIKRRGEFFELIRKNQFNLEDPHQKELFL<br>AMLMTACVLSAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 53 |
| hPDE5 (Amino acid 535-860 of WT, S766F) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLIAALSHDLDHRGVNNSYI<br>QRSEHPLAQLYCHSIMEHHHFDQCLMILNSPGNQILSGLSIEEYK<br>TTLKIIKQAILATDLALYIKRRGEFFELIRKNQFNLEDPHQKELFL<br>AMLMTACDLFAITKPWPIQQRIAELVATEFFDQGDRERKELNIEP<br>TDLMNREKKNKIPSMQVGFIDAICLQLYEALTHVSEDCFPLLDG<br>CRKNRQKWQALAEQQ | 54 |
| hPDE5 (Amino acid 535-860 of WT, K795E) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLIAALSHDLDHRGVNNSYI<br>QRSEHPLAQLYCHSIMEHHHFDQCLMILNSPGNQILSGLSIEEYK<br>TTLKIIKQAILATDLALYIKRRGEFFELIRKNQFNLEDPHQKELFL<br>AMLMTACDLSAITKPWPIQQRIAELVATEFFDQGDREREELNIEP<br>TDLMNREKKNKIPSMQVGFIDAICLQLYEALTHVSEDCFPLLDG<br>CRKNRQKWQALAEQQ | 55 |
| hPDE5 (Amino acid 535-860 of WT, L797F) | EETRELQSLAAAVVPSAQTLKITDFSFSDFELSDLETALCTIRMFT<br>DLNLVQNFQMKHEVLCRWILSVKKNYRKNVAYHNWRHAFNT<br>AQCMFAALKAGKIQNKLTDLEILALLIAALSHDLDHRGVNNSYI<br>QRSEHPLAQLYCHSIMEHHHFDQCLMILNSPGNQILSGLSIEEYK<br>TTLKIIKQAILATDLALYIKRRGEFFELIRKNQFNLEDPHQKELFL<br>AMLMTACDLSAITKPWPIQQRIAELVATEFFDQGDRERKEFNIEP<br>TDLMNREKKNKIPSMQVGFIDAICLQLYEALTHVSEDCFPLLDG<br>CRKNRQKWQALAEQQ | 56 |

TABLE 2-continued

Additional hPDE5 DDs

| hPDE5 mutant description | Amino Acid Sequence | AA SEQ ID NO |
|---|---|---|
| hPDE5 (Amino acid 535-860 of WT, I799T) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNTE PTDLMNREKKNKIPSMQVGFIDAICLQLYEALTHVSEDCFPLLD GCRKNRQKWQALAEQQ | 57 |
| hPDE5 (Amino acid 535-860 of WT, T802P) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP PDLMNREKKNKIPSMQVGFIDAICLQLYEALTHVSEDCFPLLDG CRKNRQKWQALAEQQ | 58 |
| hPDE5 (Amino acid 535-860 of WT, S815C) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPCMQVGFIDAICLQLYEALTHVSEDCFPLLDG CRKNRQKWQALAEQQ | 59 |
| hPDE5 (Amino acid 535-860 of WT, M816A) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSAQVGFIDAICLQLYEALTHVSEDCFPLLDGC RKNRQKWQALAEQQ | 60 |
| hPDE5 (Amino acid 535-860 of WT, I824T) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDATCLQLYEALTHVSEDCFPLLDG CRKNRQKWQALAEQQ | 61 |
| hPDE5 (Amino acid 535-860 of WT, C839S) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDSFPLLDG CRKNRQKWQALAEQQ | 62 |
| hPDE5 (Amino acid 535-860 of WT, K852E) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQEWQALAEQQ | 63 |
| hPDE5 (Amino acid 535-860 of WT, S560G) | EETRELQSLAAAVVPSAQTLKITDFGFSDFELSDLETALCTIRMF TDLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 64 |

TABLE 2-continued

Additional hPDE5 DDs

| hPDE5 mutant description | Amino Acid Sequence | AA SEQ ID NO |
|---|---|---|
| hPDE5 (Amino acid 535-860 of WT, V585A) | EETRELQSLAAAVVPSAQTLKITDFSFSDFELSDLETALCTIRMFT DLNLAQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 65 |
| hPDE5 (Amino acid 535-860 of WT, I599V) | EETRELQSLAAAVVPSAQTLKITDFSFSDFELSDLETALCTIRMFT DLNLVQNFQMKHEVLCRWVLSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 66 |
| hPDE5 (Amino acid 535-860 of WT, I648V) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLVAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 67 |
| hPDE5 (Amino acid 535-860 of WT, S663P) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNPYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 68 |
| hPDE5 (Amino acid 535-860 of WT, L675P) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQPYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 69 |
| hPDE5 (Amino acid 535-860 of WT, T711A) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK ATLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 70 |
| hPDE5 (Amino acid 535-860 of WT, F744L) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQLNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 71 |
| hPDE5 (Amino acid 535-860 of WT, L746S) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNSEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 72 |

TABLE 2-continued

Additional hPDE5 DDs

| hPDE5 mutant description | Amino Acid Sequence | AA SEQ ID NO |
|---|---|---|
| hPDE5 (Amino acid 535-860 of WT, F755L) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKEL<u>L</u>L AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 73 |
| hPDE5 (Amino acid 535-860 of WT, L804P) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TD<u>P</u>MNREKKNKIPSMQVGFIDAICLQLYEALTHVSEDCFPLLDG CRKNRQKWQALAEQQ | 74 |
| hPDE5 (Amino acid 535-860 of WT, M816T) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPS<u>T</u>QVGFIDAICLQLYEALTHVSEDCFPLLDGC RKNRQKWQALAEQQ | 75 |
| hPDE5 (Amino acid 535-860 of WT, F840S) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLIAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDC<u>S</u>PLLDG CRKNRQKWQALAEQQ | 76 |

In some embodiments, DDs derived from hPDE5 may include the combination of at least one, two, three, four or five mutations listed in Table 1 with at least 0, 1, 2, 3, 4, 5 or more mutations listed in Table 2.

In some embodiments, the DDs may be derived from hPDE5 (SEQ ID NO. 3), by mutating one or more amino acids residues between positions 530-550, 550-570, 570-590, 590-610, 620-640, 640-660, 660-680, 680-700, 710-730, 730-750, 750-770, 770-790, 790-810-830, 830-850, 850-860 of the catalytic domain of human PDE5 (SEQ ID NO. 1). In some embodiments, the mutation may be a conserved (with similar physicochemical properties as the amino acid at the mutation site), a semi conserved (e.g., negatively to positively charge amino acid) or a non-conserved (amino acid with different physicochemical properties than the amino acid at the mutation site). In some embodiments, the amino acid lysine may be mutated to glutamic acid or arginine; the amino acid phenylalanine may be mutated to leucine; the amino acid leucine may be mutated to phenylalanine; or the amino acid asparagine may be mutated to serine. Regions or portions or domains of wild type proteins may be utilized as SREs/DDs in whole or in part. They may be combined or rearranged to create new peptides, proteins, regions or domains of which any may be used as SREs/DDs or the starting point for the design of further SREs and/or DDs.

In some embodiments, DDs may be derived from hPDE5 by mutating amino acid residues conserved within all members of the PDE family. Exemplary conserved residues include but are not limited to, E682, H613, H617, H653, D654, and H657 residues of full length human PDE5 (SEQ ID NO. 1) and are taught in Sung et al. Nature (2003) 425, 98-102 (the contents of which are incorporated herein by reference in their entirety). In other embodiments, residues that are critical for binding to metals such as zinc and magnesium may be mutated to identify novel hPDE5 DDs. In some embodiments, hPDE5 derived DDs may be identified from a library of mutants of hPDE5 catalytic domain generated using a combination of error-prone PCR and nucleotide analog mutagenesis through random mutagenesis. Any of the mutations identified by site directed mutagenesis may be combined with the mutations identified by random mutagenesis. In some embodiments, DDs described herein may be derived by mutating the Y612 amino acid of hPDE5 (SEQ ID NO.1). In some embodiments, the mutations to the Y612 amino acid may be combined with any of the mutations described herein. Independent co-crystals of hPDE5 with vardenafil and with sildenafil, have demonstrated that one of the rings of the both ligand, interacts with Y612 of hPDE5, an amino acid located within the catalytic site of hPDE5. Interactions occur via a hydrogen bond with a water molecule and via hydrophobic bonds. Y612F mutation, which ablates the hydrogen bonding potential, increases the inhibition of hPDE5 activity by both ligands. The Y612A mutation, which leads to the ablation of both hydrogen bonding and hydrophobic bonding potential has been shown to weaken the inhibition of hPDE5 catalytic activity by vardenafil and sildenafil to a lesser extent. These studies suggest that hydrophobic bonding involving Y612 is stronger for vardenafil than for sildenafil (Corbin et al. 2006, *International Journal of Impotence Research* 18, 251-257; the contents of which are incorporated by reference in their entirety).

The destabilization domains described herein may also include amino acid and nucleotide substitutions that do not affect stability, including conservative, non-conservative substitutions and or polymorphisms.

In some embodiments, hPDE5 DDs described herein may also be fragments of the above destabilizing domains, including fragments containing variant amino acid sequences. Preferred fragments are unstable in the absence of the stimulus and stabilized upon addition of the stimulus. Preferred fragments retain the ability to interact with the stimulus with similar efficiency as the DDs described herein.

In one embodiment, hPDE5 mutants are fused to AcGFP through a linker sequence at either the N-terminal or the C-terminal end of the fusion constructs. The AcGFP of Uniprot ID BAE93141 (SEQ ID NO. 363), may be used as the GFP template and is referred to as the wildtype or "WT" version of AcGFP. In some embodiments, the hPDE5 mutants described herein may also be operably linked to a luciferase (luc) gene, such as the firefly luciferase (Fluc) or Renilla luciferase (Rluc). The position of the mutations in the Fluc protein sequence described herein are based on the comparison of the SEQ ID NO. 223 with the wildtype luciferase sequence of Photinus pyralis (Uniprot ID: P08659.1) or "Fluc WT", comprising the amino acid sequence of SEQ ID NO. 364. The destabilizing and ligand dependent stabilization properties of the fusion proteins may be evaluated by methods such as western blotting, and FACS. hPDE5 mutants that are fused to the N terminus of GFP are provided in Table 3. All constructs may be cloned into any vector known in the art and/or described herein such as, but not limited to, pLVX. IRES Puro vectors. OT-hPDE5C-036 (OT-001232) was placed under the transcriptional control of the EF1a promoter, while the other constructs described in Table 3 were placed under the transcriptional control of CMV promoter. In Table 3, and asterisk indicates the translation of the stop codon. Table 3 also provides alternate aliases for a given construct ID. These aliases are identified by the prefix OT.

TABLE 3 hPDE5-AcGFP constructs

| Construct ID/ Description | Amino Acid Sequence | AA SEQ ID NO. | NA SEQ ID NO. |
| --- | --- | --- | --- |
| Linker | GGSGGGSGG | 77 | 92 |
| Linker | GGSGGG | 78 | 93; 300 |
| Linker | SG | — | AGT GGT |
| AcGFP (Amino acid 2-239 of WT) | VSKGAELFTGIVPILIELNGDVNGHKFSVSGEGEGDATYG KLTLKFICTTGKLPVPWPTLVTTLSYGVQCFSRYPDHMKQ HDFFKSAMPEGYIQERTIFFEDDGNYKSRAEVKFEGDTLV NRIELTGTDFKEDGNILGNKMEYNYNAHNVYIMTDKAKN GIKVNFKIRHNIEDGSVQLADHYQQNTPIGDGPVLLPDNH YLSTQSALSKDPNEKRDHMIYFGFVTAAAITHGMDELYK | 79 | 372 |
| AcGFP (Amino acid 1-239 of WT) | MVSKGAELFTGIVPILIELNGDVNGHKFSVSGEGEGDATY GKLTLKFICTTGKLPVPWPTLVTTLSYGVQCFSRYPDHMK QHDFFKSAMPEGYIQERTIFFEDDGNYKSRAEVKFEGDTL VNRIELTGTDFKEDGNILGNKMEYNYNAHNVYIMTDKAK NGIKVNFKIRHNIEDGSVQLADHYQQNTPIGDGPVLLPDN HYLSTQSALSKDPNEKRDHMIYFGFVTAAAITHGMDELY K | 365 | 94, 373 |
| Fluc (Amino acid 2-549 of WT, N50D, N119G, S548I, K549A, L550V) | EDAKNIKKGPAPFYPLEDGTAGEQLHKAMKRYALVPGTI AFTDAHIEVDITYAEYFEMSVRLAEAMKRYGLNTNHRIV VCSENSLQFFMPVLGALFIGVAVAPANDIYNERELLNSMG ISQPTVVFVSKKGLQKILNVQKKLPIIQKIIIMDSKTDYQGF QSMYTFVTSHLPPGFNEYDFVPESFDRDKTIALIMNSSGST GLPKGVALPHRTACVRFSHARDPIFGNQIIPDTAILSVVPFH HGFGMFTTLGYLICGFRVVLMYRFEEELFLRSLQDYKIQS ALLVPTLFSFFAKSTLIDKYDLSNLHEIASGGAPLSKEVGE AVAKRFHLPGIRQGYGLIETTSAILITPEGDDKPGAVGKV VPFFEAKVVDLDTGKTLGVNQRGELCVRGPMIMSGYVNN PEATNALIDKDGWLHSGDIAYWDEDEHFFIVDRLKSLIKY KGYQVAPAELESILLQHPNIFDAGVAGLPDDDAGELPAAV VVLEHGKTM1EKEIVDYVASQVTTAKKLRGGVVFVDEVP KGLTGKLDARKIREILIKAKKGGKIAV | 366 | 374 |
| OT-hPDE5N-001 (OT-001075, OT-hPDE5-001) Methionine; hPDE5 (Amino acid 535-860 of WT); linker (GGSGGGSGG); AcGFP (Amino acid 2-239 of WT); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKW QALAEQQGGSGGGSGGVSKGAELFTGIVPILIELNGDVNG HKFSVSGEGEGDATYGKLTLKFICTTGKLPVPWPTLVTTL SYGVQCFSRYPDHMKQHDFFKSAMPEGYIQERTIFFEDDG NYKSRAEVKFEGDTLVNRIELTGTDFKEDGNILGNKMEY NYNAHNVYIMTDKAKNGIKVNFKIRHNIEDGSVQLADHY QQNTPIGDGPVLLPDNHYLSTQSALSKDPNEKRDHMIYFG FVTAAAITHGMDELYK* | 80 | 95 |

TABLE 3-continued hPDE5-AcGFP constructs

| Construct ID/ Description | Amino Acid Sequence | AA SEQ ID NO. | NA SEQ ID NO. |
|---|---|---|---|
| OT-hPDE5N-002 (OT-001078, OT-hPDE5-002) Methionine; hPDE5 (Amino acid 535-860 of WT, W853F); linker (GGSGGGSGG); AcGFP (Amino acid 2-239 of WT); stop) | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKF QALAEQQGGSGGGSGGVSKGAELFTGIVPILIELNGDVNG HKFSVSGEGEGDATYGKLTLKFICTTGKLPVPWPTLVTTL SYGVQCFSRYPDHMKQHDFFKSAMPEGYIQERTIFFEDDG NYKSRAEVKFEGDTLVNRIELTGTDFKEDGNILGNKMEY NYNAHNVYIMTDKAKNGIKVNFKIRHNIEDGSVQLADHY QQNTPIGDGPVLLPDNHYLSTQSALSKDPNEKRDHMIYFG FVTAAAITHGMDELYK* | 81 | 96 |
| OT-hPDE5N-003 (OT-001080, OT-hPDE5-003) Methionine; hPDE5 (Amino acid 535-860 of WT, I821A); linker (GGSGGGSGG); AcGFP (Amino acid 2-239 of WT); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFADAICLQLYEALTHVSEDCFPLLDGCRKNRQK WQALAEQQGGSGGGSGGVSKGAELFTGIVPILIELNGDVN GHKFSVSGEGEGDATYGKLTLKFICTTGKLPVPWPTLVTT LSYGVQCFSRYPDHMKQHDFFKSAMPEGYIQERTIFFEDD GNYKSRAEVKFEGDTLVNRIELTGTDFKEDGNILGNKME YNYNAHNVYIMTDKAKNGIKVNFKIRHNIEDGSVQLADH YQQNTPIGDGPVLLPDNHYLSTQSALSKDPNEKRDHMIYF GFVTAAAITHGMDELYK* | 82 | 97 |
| OT-hPDE5N-004 (OT-001081, OT-hPDE5-004) Methionine; hPDE5 (Amino acid 535-860 of WT, Y829A); linker (GGSGGGSGG); AcGFP (Amino acid 2-239 of WT); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFIDAICLQLAEALTHVSEDCFPLLDGCRKNRQKW QALAEQQGGSGGGSGGVSKGAELFTGIVPILIELNGDVNG HKFSVSGEGEGDATYGKLTLKFICTTGKLPVPWPTLVTTL SYGVQCFSRYPDHMKQHDFFKSAMPEGYIQERTIFFEDDG NYKSRAEVKFEGDTLVNRIELTGTDFKEDGNILGNKMEY NYNAHNVYIMTDKAKNGIKVNFKIRHNIEDGSVQLADHY QQNTPIGDGPVLLPDNHYLSTQSALSKDPNEKRDHMIYFG FVTAAAITHGMDELYK* | 83 | 98 |
| OT-hPDE5N-005 (OT-001074, OT-hPDE5-005) Methionine; hPDE5 (Amino acid 535-860 of WT, F787A); linker (GGSGGGSGG); AcGFP (Amino acid 2-239 of WT); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFADQGDRERKELNIEPTDLMNREKKNKI PSMQVGFIDAICLQLYEALTHVSEDCFPLLDGCRKNRQKW QALAEQQGGSGGGSGGVSKGAELFTGIVPILIELNGDVNG HKFSVSGEGEGDATYGKLTLKFICTTGKLPVPWPTLVTTL SYGVQCFSRYPDHMKQHDFFKSAMPEGYIQERTIFFEDDG NYKSRAEVKFEGDTLVNRIELTGTDFKEDGNILGNKMEY NYNAHNVYIMTDKAKNGIKVNFKIRHNIEDGSVQLADHY QQNTPIGDGPVLLPDNHYLSTQSALSKDPNEKRDHMIYFG FVTAAAITHGMDELYK* | 84 | 99 |
| OT-hPDE5N-006 (OT-001076, OT-hPDE5-006) Methionine; hPDE5 (Amino acid 535-860 of WT, F736A); linker | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFAELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKW QALAEQQGGSGGGSGGVSKGAELFTGIVPILIELNGDVNG HKFSVSGEGEGDATYGKLTLKFICTTGKLPVPWPTLVTTL | 85 | 100 |

TABLE 3-continued hPDE5-AcGFP constructs

| Construct ID/ Description | Amino Acid Sequence | AA SEQ ID NO. | NA SEQ ID NO. |
|---|---|---|---|
| (GGSGGGSGG); AcGFP (Amino acid 2-239 of WT); stop | SYGVQCFSRYPDHMKQHDFFKSAMPEGYIQERTIFFEDDG NYKSRAEVKFEGDTLVNRIELTGTDFKEDGNILGNKMEY NYNAHNVYIMTDKAKNGIKVNFKIRHNIEDGSVQLADHY QQNTPIGDGPVLLPDNHYLSTQSALSKDPNEKRDHMIYFG FVTAAAITHGMDELYK* | | |
| OT-hPDE5N-007 (OT-001082, OT-hPDE5-007) Methionine; hPDE5 (Amino acid 535-860 of WT, D656L); linker (GGSGGGSGG); AcGFP (Amino acid 2-239 of WT); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLLHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKW QALAEQQGGSGGGSGGVSKGAELFTGIVPILIELNGDVNG HKFSVSGEGEGDATYGKLTLKFICTTGKLPVPWPTLVTTL SYGVQCFSRYPDHMKQHDFFKSAMPEGYIQERTIFFEDDG NYKSRAEVKFEGDTLVNRIELTGTDFKEDGNILGNKMEY NYNAHNVYIMTDKAKNGIKVNFKIRHNIEDGSVQLADHY QQNTPIGDGPVLLPDNHYLSTQSALSKDPNEKRDHMIYFG FVTAAAITHGMDELYK* | 86 | 101 |
| OT-hPDE5N-008 (OT-001083, OT-hPDE5-008) Methionine; hPDE5 (Amino acid 535-860 of WT, Y728L); linker (GGSGGGSGG); AcGFP (Amino acid 2-239 of WT); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALLIKRRG EFFELIRKNQFNLEDPHQKELFLAMLMTACDLSAITKPWPI QQRIAELVATEFFDQGDRERKELNIEPTDLMNREKKNKIPS MQVGFIDAICLQLYEALTHVSEDCFPLLDGCRKNRQKWQ ALAEQQGGSGGGSGGVSKGAELFTGIVPILIELNGDVNGH KFSVSGEGEGDATYGKLTLKFICTTGKLPVPWPTLVTTLS YGVQCFSRYPDHMKQHDFFKSAMPEGYIQERTIFFEDDGN YKSRAEVKFEGDTLVNRIELTGTDFKEDGNILGNKMEYN YNAHNVYIMTDKAKNGIKVNFKIRHNIEDGSVQLADHYQ QNTPIGDGPVLLPDNHYLSTQSALSKDPNEKRDHMIYFGF VTAAAITHGMDELYK* | 87 | 102 |
| OT-hPDE5N-009 (OT-001084, OT-hPDE5-009) Methionine; hPDE5 (Amino acid 535-860 of WT, R732L); linker (GGSGGGSGG); AcGFP (Amino acid 2-239 of WT); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRLG EFFELIRKNQFNLEDPHQKELFLAMLMTACDLSAITKPWPI QQRIAELVATEFFDQGDRERKELNIEPTDLMNREKKNKIPS MQVGFIDAICLQLYEALTHVSEDCFPLLDGCRKNRQKWQ ALAEQQGGSGGGSGGVSKGAELFTGIVPILIELNGDVNGH KFSVSGEGEGDATYGKLTLKFICTTGKLPVPWPTLVTTLS YGVQCFSRYPDHMKQHDFFKSAMPEGYIQERTIFFEDDGN YKSRAEVKFEGDTLVNRIELTGTDFKEDGNILGNKMEYN YNAHNVYIMTDKAKNGIKVNFKIRHNIEDGSVQLADHYQ QNTPIGDGPVLLPDNHYLSTQSALSKDPNEKRDHMIYFGF VTAAAITHGMDELYK* | 88 | 103 |
| OT-hPDE5N-010 (OT-001070, OT-hPDE5-010) Methionine; hPDE5 (Amino acid 535-860 of WT, M625I); linker (GGSGGGSGG); AcGFP (Amino acid 2-239 of WT); stop | MEETRELQSLAAAVVPSAQTLKITDFSFSDFELSDLETALC TIRMFTDLNLVQNFQMKHEVLCRWILSVKKNYRKNVAY HNWRHAFNTAQCIFAALKAGKIQNKLTDLEILALLIAALS HDLDHRGVNNSYIQRSEHPLAQLYCHSIMEHHHFDQCLMI LNSPGNQILSGLSIEEYKTTLKIIKQAILATDLALYIKRRGEF FELIRKNQFNLEDPHQKELFLAMLMTACDLSAITKPWPIQ QRIAELVA1EFFDQGDRERKELNIEPTDLMNREKKNKIPS MQVGFIDAICLQLYEALTHVSEDCFPLLDGCRKNRQKWQ ALAEQQGGSGGGSGGVSKGAELFTGIVPILIELNGDVNGH KFSVSGEGEGDATYGKLTLKFICTTGKLPVPWPTLVTTLS YGVQCFSRYPDHMKQHDFFKSAMPEGYIQERTIFFEDDGN YKSRAEVKFEGDTLVNRIELTGTDFKEDGNILGNKMEYN YNAHNVYIMTDKAKNGIKVNFKIRHNIEDGSVQLADHYQ QNTPIGDGPVLLPDNHYLSTQSALSKDPNEKRDHMIYFGF VTAAAITHGMDELYK* | 89 | 104 |
| OT-hPDE5-028 (OT-001224) Methionine; | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL | 90 | 105 |

TABLE 3-continued hPDE5-AcGFP constructs

| Construct ID/ Description | Amino Acid Sequence | AA SEQ ID NO. | NA SEQ ID NO. |
|---|---|---|---|
| hPDE5 (Amino acid 535-860 of WT); linker (GGSGGG); AcGFP (Amino acid 2-239 of WT); stop | MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKW QALAEQQGGSGGGVSKGAELFTGIVPILIELNGDVNGHKF SVSGEGEGDATYGKLTLKFICTTGKLPVPWPTLVTTLSYG VQCFSRYPDHMKQHDFFKSAMPEGYIQERTIFFEDDGNYK SRAEVKFEGDTLVNRIELTGTDFKEDGNILGNKMEYNYN AHNVYIMTDKAKNGIKVNFKIRHNIEDGSVQLADHYQQN TPIGDGPVLLPDNHYLSTQSALSKDPNEKRDHMIYFGFVT AAAITHGMDELYK* | | |
| OT-hPDE5C-036 (OT-001232; OT-hPDE5-036) AcGFP (Amino acid 1-239 of WT); linker (SG); hPDE5 (Amino acid 535-860 of WT); stop | MVSKGAELFTGIVPILIELNGDVNGHKFSVSGEGEGDATY GKLTLKFICTTGKLPVPWPTLVTTLSYGVQCFSRYPDHMK QHDFFKSAMPEGYIQERTIFFEDDGNYKSRAEVKFEGDTL VNRIELTGTDFKEDGNILGNKMEYNYNAHNVYIMTDKAK NGIKVNFKIRHNIEDGSVQLADHYQQNTPIGDGPVLLPDN HYLSTQSALSKDPNEKRDHMIYFGFVTAAAITHGMDELY KSGEETRELQSLAAAVVPSAQTLKITDFSFSDFELSDLETA LCTIRMFTDLNLVQNFQMKHEVLCRWILSVKKNYRKNVA YHNWRHAFNTAQCMFAALKAGKIQNKLTDLEILALLIAA LSHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKW QALAEQQ* | 91 | 106 |
| OT-hPDE5-031 (OT-001227) Methionine; hPDE5 (Amino acid 535-860 of WT); linker (SG); Fluc (N50D, N119G, S548I, K549A, L550V); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKW QALAEQQSGEDAKNIKKGPAPFYPLEDGTAGEQLHKAMK RYALVPGTIAFTDAHIEVDITYAEYFEMSVRLAEAMKRYG LNTNHRIVVCSENSLQFFMPVLGALFIGVAVAPANDIYNE RELLNSMGISQPTVVFVSKKGLQKILNVQKKLPIIQKIIIMD SKTDYQGFQSMYTFVTSHLPPGFNEYDFVPESFDRDKTIA LIMNSSGSTGLPKGVALPHRTACVRFSHARDPIFGNQIIPD TAILSVVPFHHGFGMFTTLGYLICGFRVVLMYRFEEELFLR SLQDYKIQSALLVPTLFSFFAKSTLIDKYDLSNLHEIASGG APLSKEVGEAVAKRFHLPGIRQGYGLIETTSAILITPEGDD KPGAVGKVVPFFEAKVVDLDTGKTLGVNQRGELCVRGP MIMSGYVNNPEATNALIDKDGWLHSGDIAYWDEDEHFFI VDRLKSLIKYKGYQVAPAELESILLQHPNIFDAGVAGLPD DDAGELPAAVVVLEHGKTMIEKEIVDYVASQVTTAKKLR GGVVFVDEVPKGLTGKLDARKIREILIKAKKGGKIAV* | 367 | 375 |
| OT-hPDE5-032 (OT-001228) Methionine; hPDE5 (Amino acid 535-860 of WT, F736A); linker (SG); Fluc (N50D, N119G, S548I, K549A, L550V); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFAELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKW QALAEQQSGEDAKNIKKGPAPFYPLEDGTAGEQLHKAMK RYALVPGTIAFTDAHIEVDITYAEYFEMSVRLAEAMKRYG LNTNHRIVVCSENSLQFFMPVLGALFIGVAVAPANDIYNE RELLNSMGISQPTVVFVSKKGLQKILNVQKKLPIIQKIIIMD SKTDYQGFQSMYTFVTSHLPPGFNEYDFVPESFDRDKTIA LIMNSSGSTGLPKGVALPHRTACVRFSHARDPIFGNQIIPD TAILSVVPFHHGFGMFTTLGYLICGFRVVLMYRFEEELFLR SLQDYKIQSALLVPTLFSFFAKSTLIDKYDLSNLHEIASGG APLSKEVGEAVAKRFHLPGIRQGYGLIETTSAILITPEGDD KPGAVGKVVPFFEAKVVDLDTGKTLGVNQRGELCVRGP MIMSGYVNNPEATNALIDKDGWLHSGDIAYWDEDEHFFI VDRLKSLIKYKGYQVAPAELESILLQHPNIFDAGVAGLPD DDAGELPAAVVVLEHGKTMIEKEIVDYVASQVTTAKKLR GGVVFVDEVPKGLTGKLDARKIREILIKAKKGGKIAV* | 368 | 376 |

TABLE 3-continued hPDE5-AcGFP constructs

| Construct ID/ Description | Amino Acid Sequence | AA SEQ ID NO. | NA SEQ ID NO. |
|---|---|---|---|
| OT-hPDE5-033 (OT-001229) Methionine; hPDE5 (Amino acid 535-860 of WT, R732L); Linker (SG); Fluc (N50D, N119G, S548I, K549A, L550V); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRLG EFFELIRKNQFNLEDPHQKELFLAMLMTACDLSAITKPWPI QQRIAELVATEFFDQGDRERKELNIEPTDLMNREKKNKIPS MQVGFIDAICLQLYEALTHVSEDCFPLLDGCRKNRQKWQ ALAEQQSGEDAKNIKKGPAPFYPLEDGTAGEQLHKAMKR YALVPGTIAFTDAHIEVDITYAEYFEMSVRLAEAMKRYGL NTNHRIVVCSENSLQFFMPVLGALFIGVAVAPANDIYNER ELLNSMGISQPTVVFVSKKGLQKILNVQKKLPIIQKIIIMDS KTDYQGFQSMYTFVTSHLPPGFNEYDFVPESFDRDKTIALI MNSSGSTGLPKGVALPHRTACVRFSHARDPIFGNQIIPDTA ILSVVPFHHGFGMFTTLGYLICGFRVVLMYRFEEELFLRSL QDYKIQSALLVPTLFSFFAKSTLIDKYDLSNLHEIASGGAP LSKEVGEAVAKRFHLPGIRQGYGLIETTSAILITPEGDDKP GAVGKVVPFFEAKVVDLDTGKTLGVNQRGELCVRGPMI MSGYVNNPEATNALIDKDGWLHSGDIAYWDEDEHFFIVD RLKSLIKYKGYQVAPAELESILLQHPNIFDAGVAGLPDDD AGELPAAVVVLEHGKTMTEKEIVDYVASQVTTAKKLRGG VVFVDEVPKGLTGKLDARKIREILIKAKKGGKIAV* | 369 | 377 |
| OT-hPDE5-086 (OT-001211) AcGFP (Amino acid 1-239 of WT); linker (SG); hPDE5 (Amino acid 535-860 of WT, H653A); stop | MVSKGAELFTGIVPILIELNGDVNGHKFSVSGEGEGDATY GKLTLKFICTTGKLPVPWPTLVTTLSYGVQCFSRYPDHMK QHDFFKSAMPEGYIQERTIFFEDDGNYKSRAEVKFEGDTL VNRIELTGTDFKEDGNILGNKMEYNYNAHNVYIMTDKAK NGIKVNFKIRHNIEDGSVQLADHYQQNTPIGDGPVLLPDN HYLSTQSALSKDPNEKRDHMIYFGFVTAAAITHGMDELY KSGEETRELQSLAAAVVPSAQTLKITDFSFSDFELSDLETA LCTIRMFTDLNLVQNFQMKHEVLCRWILSVKKNYRKNVA YHNWRHAFNTAQCMFAALKAGKIQNKLTDLEILALLIAA LSADLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKPW PIQQRIAELVATEFFDQGDRERKELNIEPTDLMNREKKNKI PSMQVGFIDAICLQLYEALTHVSEDCFPLLDGCRKNRQKW QALAEQQ* | 370 | 378 |
| OT-hPDE5-087 (OT-001208) AcGFP (Amino acid 1-239 of WT); linker (SG); hPDE5 (Amino acid 535-860 of WT, D764A); stop | MVSKGAELFTGIVPILIELNGDVNGHKFSVSGEGEGDATY GKLTLKFICTTGKLPVPWPTLVTTLSYGVQCFSRYPDHMK QHDFFKSAMPEGYIQERTIFFEDDGNYKSRAEVKFEGDTL VNRIELTGTDFKEDGNILGNKMEYNYNAHNVYIMTDKAK NGIKVNFKIRHNIEDGSVQLADHYQQNTPIGDGPVLLPDN HYLSTQSALSKDPNEKRDHMIYFGFVTAAAITHGMDELY KSGEETRELQSLAAAVVPSAQTLKITDFSFSDFELSDLETA LCTIRMFTDLNLVQNFQMKHEVLCRWILSVKKNYRKNVA YHNWRHAFNTAQCMFAALKAGKIQNKLTDLEILALLIAA LSHDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACALSAITKPW PIQQRIAELVATEFFDQGDRERKELNIEPTDLMNREKKNKI PSMQVGFIDAICLQLYEALTHVSEDCFPLLDGCRKNRQKW QALAEQQ* | 371 | 379 |

In addition to human PDE5, other phosphodiesterases may also be used to generate novel destabilizing domains. The human PDE superfamily includes 11 structurally related but functionally distinct gene families (hPDE1 to hPDE11). These differ in their cellular functions, primary structures, affinities for cAMP and cGMP, catalytic properties and response to specific activators, inhibitors, effectors and mechanisms of regulation. As modular proteins, hPDEs exhibit a common structural organization with divergent amino-terminal regulatory regions and conserved carboxy-terminal catalytic core. The hPDE family proteins contain an N terminal regulatory region and a C terminal catalytic region. The N-terminal regulatory regions contain structural determinants that target individual hPDEs to different subcellular locations, and allow individual hPDEs to specifically respond to different post translational modification. The structural elements include dimerization domains, auto-inhibitory modules, binding sites for ligands and allosteric effectors. In contrast, the X ray crystal structure isolated catalytic domains of nine hPDE families (hPDE1 to hPDE5 and hPDE7 to hPDE10) have demonstrated that the catalytic domains of hPDEs share a similar topography, composed of ~350 amino acids folded into 16 helices. Across the hPDE families, the active site forms a deep hydrophobic pocket that contains a hPDE specific, histidine-containing signature motif, $HD(X_2) H(X_4) N$ (SEQ ID NO: 8377), and binding sites for two divalent metal ions that are essential for catalytic function. The affinity of hPDEs to specific cyclic nucleotides varies within the family-some hPDEs specifically hydrolyze cAMP (hPDE4, hPDE7 and hPDE8), whereas others hydrolyze cGMP (hPDE5, hPDE6 and hPDE9), and some hydrolyze both cAMP and cGMP (hPDE1, hPDE2, hPDE3, hPDE10 and hPDE11).

Similar to hPDE5, the catalytic domain or other functional domain of any hPDE family member may be mutagenized and screened for destabilizing mutations. Known inhibitors for each hPDE protein may also be tested for ligand-dependent stabilization.

In some embodiments, known mutations in phosphodiesterases that affect protein stability may be utilized to identify novel hPDE derived DDs. Mutations previously identified include, but are not limited to, hPDE5 (I778T), or hPDE6C (H602L), hPDE6C (E790K), hPDE6C (R104W), hPDE6C (Y323N), and hPDE6C (P391L) or hPDE4D (S752A), hPDE4D (S754A), hPDE4D (S752A, S754A), and hPDE4D (E757A, E758A, D759A) (Zhu et al. (2010) Mol Cell Biol. 4379-4390; Alexandre et al. (2015). Endocr. Relat. Cancer 22(4):519-30; Cheguru P. et al. (2015) Mol Cell Neurosci; 64: 1-8; the contents of each of which are incorporated herein by reference in their entirety).

In some embodiments, novel DDs may be generated from hPDE1 which is also known as calcium and calmodulin dependent phosphodiesterase. It has three subtypes hPDE1A, hPDE1B and hPDE1C. The enzyme contains three functional domains; a conserved catalytic core, a regulatory N-terminus and a C-terminus. The catalytic domains of hPDE1 have three helical subdomains; an N-terminal cyclin fold region, a linker region and a C-terminal helical bundle. Vinpocetine is a known inhibitor of hPDE1.

In some embodiments, novel DDs may be generated from hPDE2, a dual substrate enzyme that hydrolyzes both cAMP and cGMP. The distinguishing feature of this hPDE is that it is allosterically stimulated by cGMP binding to one of its GAF domains. The crystal structure of hPDE2 GAF-B domain reveals that the GAF-B domain binds cGMP with high affinity and selectivity. Exemplary hPDE2 inhibitors include EHNA (erythro-9-(2-hydroxy-3-nonyl) adenine), Oxindole, PDP and BAY 60-7550. Inhibitors that selectively inhibit a hPDE2 isoform may also be used, for example, substituted pyrido (2,3-b) pyrazines having a hPDE2A selective inhibitory action (See, e.g., U.S. Pat. No. 9,527,841; the contents of which are incorporated by reference in its entirety.)

In some embodiments, novel DDs may be generated from hPDE3 which preferentially hydrolyses cAMP. Like other hPDE family members, it comprises three functional domains, a conserved catalytic core, a regulatory terminus and the C-terminus. The catalytic core of hPDE is characterized by a unique 44-amino acid insert. Amrinone, Cilostazol, Milrinone, Enoximone and Pimobendan are inhibitors for hPDE3 enzyme.

In some embodiments, novel DDs may be generated from hPDE4, the principal second messenger for immune response regulation and is responsible for the hydrolysis of cAMP. Four isoforms of hPDE4 exist with each isoform having a unique N terminal region that specifies cellular localization by mediating interactions with scaffolding proteins which may further comprise upstream conserved regions (UCRs). All isoforms share invariant catalytic domain. The catalytic pocket is lined with highly conserved and invariant residues, including an invariant glutamine (Q369) that forms crucial hydrogen bond with substrates. Analyses of crystal structure of hPDE-inhibitor complexes suggest that two conserved residues are essential for inhibitor binding. The formation of hydrogen bonds with invariant glutamine determines the orientation of the inhibitors and conserved hydrophobic residues (1336 and F340) form a hydrophobic clamp that anchors inhibitors in the pocket. A number of small molecules can inhibit hPDE 4 activity, some of which are FDA approved such as AN2728 (4-[(1-hydroxy-1,3-dihydro-2,1-benzoxaborol-5-yl) oxy]benzonitrile), Apremilast/CC10004 (N-{2-[(1S)-1-(3-Ethoxy-4-methoxyphenyl)-2-(methyl sulfonyl) ethyl]-1,3-dioxo-2,3-dihydro-1H-isoindol-4-yl}acetamide), and Roflumilast. Other small molecules that inhibit hPDE4 also include E6005/RVT501, Cilomilast/SB-207,499, Ibudilast (AV-411 or MN-166), Mesembrenone, Piclamilast/RP 73401, Rolipram, Atizoram/CP-80633, Arofylline, CC-1088, Catramilast, CGH-2466, Cipamfylline, Drotaverine, Filaminast/WAY-PDA 641, HT-0712, DNS-001, ICI-63197, Indimilast, Irsogladine/MN 1695, Lirimilast/BAY 19-8004, Oglemilast, Revamilast, Ro 20-1724, Ronomilast, GSK256066, DC-TA-46, AWD 12-281 and YM-976.

In some embodiments, novel DDs may be generated from hPDE6. This holoenzyme includes hPDE6 alpha, hPDE6 beta and/or two identical inhibitory subunits of hPDE6 gamma. hPDE6 alpha and beta forms comprise three domains: two N-terminal GAF domains and one C-terminal catalytic domain. The non-catalytic GAF domains are responsible for cGMP binding.

In some embodiments, novel DDs may be generated from hPDE7, a cAMP specific hPDE which consists of two genes, hPDE7A and hPDE7B. There are no known regulatory domains on the N terminus as established for most of the other hPDE families, although consensus PKA phosphorylation sites exist in this region. Several small molecules can inhibit PDE7, including BRL-50481 (N, N,2-Trimethyl-5-nitrobenzenesulfonamide) and ASB 16165 (1H-Thieno(2,3-C) pyrazole-5-carboxamide, 1-cyclohexyl-N-(6-(4-hydroxy-1-piperidinyl)-3-pyridinyl)-3-methyl).

In some embodiments, novel DDs may be generated from hPDE8. Two subfamilies of hPDE8 exist and both they have very high affinity for the substrate cAMP and are insensitive to the non-specific PDE inhibitor IBMX. Each protein contains a catalytic core, a PAS (Per, Arnt and Sim) and a REC (receiver) domain. The crystal structure of the catalytic core of hPDE8 identified Tyr748 residue as a unique residue that distinguishes hPDE8 inhibitor binding from other hPDE proteins bound to inhibitors. PF-04957325 (Pfizer) is a small molecule inhibitor of hPDE8.

In some embodiments, novel DDs may be generated from hPDE9, which has the highest affinity for cGMP. The primary structure of hPDE9A is simple as it does not appear to contain any GAF domains or other N-terminal regulatory sequences found in other hPDEs. The catalytic pocket is lined with highly conserved and invariant residues, including an invariant glutamine Gln 453 in hPDE9A2 that forms crucial hydrogen bond with substrates. The formation of hydrogen bonds with invariant glutamine determines the orientation of the inhibitors and conserved hydrophobic residues form a hydrophobic clamp that anchors inhibitors in the pocket and wedges their ring structures against F456 in hPDE9A. Tested hPDE9 inhibitors may include BAY73-6691 (1-(2-chlorophenyl)-6-[(2R)-3,3,3-trifluoro-2-methylpropyl]-1,5-dihydro-4H-pyrazolo[3,4-d]pyrimidine-4-one), PF-04447943 (6-[(3S,4S)-4-methyl-1-(pyrimidin-2-ylmethyl)pyrrolidin-3-yl]-1-(oxan-4-yl)-2H-pyrazolo[3,4-d]pyrimidin-4-one) and WYQ-C28L.

In some embodiments, novel DDs may be generated from hPDE10, which can hydrolyze both cAMP and cGMP. Like some other hPDE family proteins, hPDE10 comprises 2 GAF domains in the N terminal region, a Protein Kinase A phosphorylation site and a catalytic domain. The catalytic pocket is lined with highly conserved and invariant residues, including an invariant glutamine Q726 in hPDE10A2 that forms crucial hydrogen bond with substrates. Several PDE10 inhibitors are under clinical trials including OMS 824, Papaverine and PF-2545920 (2-(4-(1-methyl-4-pyridin-4-yl-1H-pyrazol-3-yl) phenoxymethyl) quinolone).

In some embodiments, novel DDs may be generated from hPDE11. Like hPDE10, the recently discovered hPDE11 can hydrolyze both cAMP and cGMP. It comprises of only one gene with four isoform variants. The longest variant, hPDE11A4, has two N-terminal GAF domains, whereas the other variants are truncations of this variant of varying lengths.

In some embodiments, any of the destabilizing mutations related to hPDE5 described herein may be structurally mapped onto other phosphodiesterases to generate destabilizing domains. In one embodiment, mutations that destabilize hPDE5, and which subsequently result in stabilization in the presence of sildenafil and/or vardenafil may be engineered onto hPDE6. In one embodiment, mutations that destabilize hPDE5, and which subsequently result in stabilization in the presence of Tadalafil may be engineered onto hPDE11.

The full length hPDEs and their catalytic domains that may be utilized to derive novel DDs are listed in Table 4.

TABLE 4

| Sequences of human PDE proteins and their catalytic domains | | |
|---|---|---|
| PDE protein (Uniprot ID or domain description) | Amino Acid sequence | AA SEQ ID NO. |
| hPDE1A (Uniprot ID: P54750) | MDDHVTIRKKHLQRPIFRLRCLVKQLERGDVNVVDLKKNIEYAA SVLEAVYIDETRRLLDTEDELSDIQTDSVPSEVRDWLASTFTRKM GMTKKKPEEKPKFRSIVHAVQAGIFVERMYRKTYHMVGLAYPA AVIVTLKDVDKWSFDVFALNEASGEHSLKFMIYELFTRYDLINRF KIPVSCLITFAEALEVGYSKYKNPYHNLIHAADVTQTVHYIMLHT GIMHWLIELEILAMVFAAAIHDYEHTGTTNNFHIQTRSDVAILYN DRSVLENHHVSAAYRLMQEEEMNILINLSKDDWRDLRNLVIEMV LSTDMSGHFQQIKNIRNSLQQPEGIDRAKTMSLILHAADISHPAKS WKLHYRWTMALMEEFFLQGDKEAELGLPFSPLCDRKSTMVAQS QIGFIDFIVEPTFSLLTDSTEKIVIPLIEEASKAETSSYVASSSTTIVG LHIADALRRSNTKGSMSDGSYSPDYSLAAVDLKSFKNNLVDIIQQ NKERWKELAAQEARTSSQKCEFIHQ | 107 |
| hPDE1A Catalytic domain (Amino acid 193-515 of PDE1A) | FKIPVSCLITFAEALEVGYSKYKNPYHNLIHAADVTQTVHYIMLH TGIMHWLTELEILAMVFAAAIHDYEHTGTTNNFHIQTRSDVAILY NDRSVLENHHVSAAYRLMQEEEMNILINLSKDDWRDLRNLVIEM VLSTDMSGHFQQIKNIRNSLQQPEGIDRAKTMSLILHAADISHPAK SWKLHYRWTMALMEEFFLQGDKEAELGLPFSPLCDRKSTMVAQ SQIGFIDFIVEPTFSLLTDSTEKIVIPLIEEASKAETSSYVASSSTTIVG LHIADALRRSNTKGSMSDGSYSPDYSLAAVDLKSFKNNLVDIIQQ NKERW | 108 |
| hPDE1B (Uniprot ID: Q01064) | MELSPRSPPEMLEESDCPSPLELKSAPSKKMWIKLRSLLRYMVKQ LENGEINIEELKKNLEYTASLLEAVYIDETRQILDIEDELQELRSD AVPSEVRDWLASTFTQQARAKGRRAEEKPKFRSIVHAVQAGIFV ERMFRRTYTSVGPTYSTAVLNCLKNLDLWCFDVFSLNQAADDH ALRTIVFELLTRHNLISRFKIPTVFLMSFLDALETGYGKYKNPYHN QIHAADVTQTVHCFLLRTGMVHCLSEIELLAIIFAAAIHDYEHTGT TNSFHIQTKSECAIVYNDRSVLENHHISSVFRLMQDDEMNIFINLT KDEFVELRALVIEMVLATDMSCHFQQVKTMKTALQQLERIDKPK ALSLLLHAADISHPTKQWLVHSRWTKALMEEFFRQGDKEAELGL PFSPLCDRTSTLVAQSQIGFIDFIVEPTFSVLTDVAEKSVQPLADED SKSKNQPSFQWRQPSLDVEVGDPNPDVVSFRSTWVKRIQENKQK WKERAASGITNQMSIDELSPCEEEAPPSPAEDEHNQNGNLD | 109 |
| hPDE1B Catalytic domain (Amino acid 197-496 of PDE1B) | FKIPTVFLMSFLDALETGYGKYKNPYHNQIHAADVTQTVHCFLLR TGMVHCLSEIELLAIIFAAAIHDYEHTGTTNSFHIQTKSECAIVYND RSVLENHHISSVFRLMQDDEMNIFINLTKDEFVELRALVIEMVLA TDMSCHFQQVKTMKTALQQLERIDKPKALSLLLHAADISHPTKQ WLVHSRWTKALMEEFFRQGDKEAELGLPFSPLCDRTSTLVAQSQ IGFIDFIVEPTFSVLTDVAEKSVQPLADEDSKSKNQPSFQWRQPSL DVEVGDPNPDVVSFRSTWVKRIQENKQKW | 110 |
| hPDE1C (Uniprot ID: Q14123) | MESPTKEIEEFESNSLKYLQPEQIEKIWLRLRGLRKYKKTSQRLRS LVKQLERGEASVVDLKKNLEYAATVLESVYIDETRRLLDTEDELS DIQSDAVPSEVRDWLASTFTRQMGMMLRRSDEKPRFKSIVHAVQ AGIFVERMYRRTSNMVGLSYPPAVIEALKDVDKWSFDVFSLNEA SGDHALKFIFYELLTRYDLISRFKIPISALVSFVEALEVGYSKHKNP YHNLMHAADVTQTVHYLLYKTGVANWLTELEIFAIIFSAAIHDYE HTGTTNNFHIQTRSDPAILYNDRSVLENHHLSAAYRLLQDDEEM NILINLSKDDWREFRTLVIEMVMATDMSCHFQQIKAMKTALQQP EAIEKPKALSLMLHTADISHPAKAWDLHHRWTMSLLEEFFRQGD REAELGLPFSPLCDRKSTMVAQSQVGFIDFIVEPTFTVLTDMTEKI VSPLIDETSQTGGTGQRRSSLNSISSSDAKRSGVKTSGSEGSAPINN SVISVDYKSFKATWTEVVHINRERWRAKVPKEEKAKKEAEEKAR LAAEEQQKEMEAKSQAEEGASGKAEKKTSGETKNQVNGTRANK SDNPRGKNSKAEKSSGEQQQNGDFKDGKNKTDKKDHSNIGNDS KKTDGTKQRSHGSPAPSTSSTCRLTLPVIKPPLRHFKRPAYASSSY APSVSKKTDEHPARYKMLDQRIKMKKIQNISHNWNRK | 111 |

TABLE 4-continued

Sequences of human PDE proteins and their catalytic domains

| PDE protein (Uniprot ID or domain description) | Amino Acid sequence | AA SEQ ID NO. |
|---|---|---|
| hPDE1C Catalytic domain (Amino acid 202-521 of PDE1C) | FKIPISALVSFVEALEVGYSKHKNPYHNLMHAADVTQTVHYLLY KTGVANWLTELEIFAIIFSAAIHDYEHTGTTNNFHIQTRSDPAILYN DRSVLENHHLSAAYRLLQDDEEMNILINLSKDDWREFRTLVIEM VMATDMSCHFQQIKAMKTALQQPEAIEKPKALSLMLHTADISHP AKAWDLHHRWTMSLLEEFFRQGDREAELGLPFSPLCDRKSTMV AQSQVGFIDFIVEPTFTVLTDMIEKIVSPLIDETSQTGGTGQRRSSL NSISSSDAKRSGVKTSGSEGSAPINNSVISVDYKSFKATWTEVVHI NRERW | 112 |
| hPDE2A (Uniprot ID: O00408) | MGQACGHSILCRSQQYPAARPAEPRGQQVFLKPDEPPPPPQPCAD SLQDALLSLGSVIDISGLQRAVKEALSAVLPRVETVYTYLLDGES QLVCEDPPHELPQEGKVREAIISQKRLGCNGLGFSDLPGKPLARL VAPLAPDTQVLVMPLADKEAGAVAAVILVHCGQLSDNEEWSLQ AVEKHTLVALRRVQVLQQRGPREAPRAVQNPPEGTAEDQKGGA AYTDRDRKILQLCGELYDLDASSLQLKVLQYLQQETRASRCCLL LVSEDNLQLSCKVIGDKVLGEEVSFPLTGCLGQVVEDKKSIQLKD LTSEDVQQLQSMLGCELQAMLCVPVISRATDQVVALACAFNKLE GDLFTDEDEHVIQHCFHYTSTVLTSTLAFQKEQKLKCECQALLQV AKNLFTHLDDVSVLLQEIITEARNLSNAEICSVFLLDQNELVAKVF DGGVVDDESYEIRIPADQGIAGHVATTGQILNIPDAYAHPLFYRG VDDSTGFRTRNILCFPIKNENQEVIGVAELVNKINGPWFSKFDEDL ATAFSIYCGISIAHSLLYKKVNEAQYRSHLANEMMMYHMKVSDD EYTKLLHDGIQPVAAIDSNFASFTYTPRSLPEDDTSMAILSMLQD MNFINNYKIDCPTLARFCLMVKKGYRDPPYHNWMHAFSVSHFC YLLYKNLELTNYLEDIEIFALFISCMCHDLDHRGTNNSFQVASKS VLAALYSSEGSVMERHHFAQAIAILNTHGCNIFDHFSRKDYQRML DLMRDIILATDLAHHLRIFKDLQKMAEVGYDRNNKQHHRLLLCL LMTSCDLSDQTKGWKTTRKIAELIYKEFFSQGDLEKAMGNRPME MMDREKAYIPELQISFMEHIAMPIYKLLQDLFPKAAELYERVASN REHWTKVSHKFTIRGLPSNNSLDFLDEEYEVPDLDGTRAPINGCC SLDAE | 113 |
| hPDE2A Catalytic domain (Amino acid 633-891 of PDE2A) | KIDCPTLARFCLMVKKGYRDPPYHNWMHAFSVSHFCYLLYKNL ELTNYLEDIEIFALFISCMCHDLDHRGTNNSFQVASKSVLAALYSS EGSVMERHHFAQATAILNTHGCNIFDHFSRKDYQRMLDLMRDIIL ATDLAHHLRIFKDLQKMAEVGYDRNNKQHHRLLLCLLMTSCDL SDQTKGWKTTRKIAELIYKEFFSQGDLEKAMGNRPMEMMDREK AYIPELQISFMEHIAMPIYKLLQDLFPKAAELYERVASN | 114 |
| hPDE3A (Uniprot ID: Q14432) | MAVPGDAARVRDKPVHSGVSQAPTAGRDCHHRADPASPRDSGC RGCWGDLVLQPLRSSRKLSSALCAGSLSFLLALLVRLVRGEVGC DLEQCKEAAAAEEEEAAPGAEGGVFPGPRGGAPGGGARLSPWL QPSALLFSLLCAFFWMGLYLLRAGVRLPLAVALLAACCGGEALV QIGLGVGEDHLLSLPAAGVVLSCLAAATWLVLRLRLGVLMIALT SAVRTVSLISLERFKVAWRPYLAYLAGVLGILLARYVEQILPQSA EAAPREHLGSQLIAGTKEDIPVFKRRRRSSSVVSAEMSGCSSKSHR RTSLPCIPREQLMGHSEWDHKRGPRGSQSSGTSITVDIAVMGEAH GLITDLLADPSLPPNVCTSLRAVSNLLSTQLTFQAIHKPRVNPVTS LSENYTCSDSEESSEKDKLAIPKRLRRSLPPGLLRRVSSTWTTTTS ATGLPTLEPAPVRRDRSTSIKLQEAPSSSPDSWNNPVMMTLTKSR SFTSSYAISAANHVKAKKQSRPGALAKISPLSSPCSSPLQGTPASSL VSKISAVQFPESADTTAKQSLGSHRALTYTQSAPDLSPQILTPPVIC SSCGRPYSQGNPADEPLERSGVATRTPSRTDDTAQVTSDYETNNN SDSSDIVQNEDETECLREPLRKASACSTYAPETMMFLDKPILAPEP LVMDNLDSIMEQLNTWNFPIFDLVENIGRKCGRILSQVSYRLFED MGLFEAFKIPIREFMNYFHALEIGYRDIPYHNRIHATDVLHAVWY LTTQPIPGLSTVINDHGSTSDSDSGFTHGHMGYVFSKTYNVTD DKYGCLSGNIPALELMALYVAAAMHDYDHPGRTNAFLVATSAP QAVLYNDRSVLENHHAAAAWNLFMSRPEYNFLINLDHVEFKHF RFLVIEAILATDLKKHFDFVAKFNGKVNDDVGIDWTNENDRLLV CQMCIKLADINGPAKCKELHLQWTDGIVNEFYEQGDEEASLGLPI SPFMDRSAPQLANLQESFISHIVGPLCNSYDSAGLMPGKWVEDSD ESGDTDDPEEEEEEAPAPNEEETCENNESPKKKTFKRRRKIYCQITQ HLLQNHKMWKKVIEEEQRLAGIENQSLDQTPQSHSSEQIQAIKEE EEEKGKPRGEEIPTQKPDQ | 115 |

TABLE 4-continued

Sequences of human PDE proteins and their catalytic domains

| PDE protein (Uniprot ID or domain description) | Amino Acid sequence | AA SEQ ID NO. |
|---|---|---|
| hPDE3A Catalytic domain (Amino acid 728-1086 of PDE3A) | FKIPIREFMNYFHALEIGYRDIPYHNRIHATDVLHAVWYLTTQPIP GLSTVINDHGSTSDSDSGFTHGHMGYVFSKTYNVTDDKYGCL SGNIPALELMALYVAAAMHDYDHPGRTNAFLVATSAPQAVLYN DRSVLENHHAAAAWNLFMSRPEYNFLINLDHVEFKHFRFLVIEAI LATDLKKHFDFVAKFNGKVNDDVGIDWTNENDRLLVCQMCIKL ADINGPAKCKELHLQWTDGIVNEFYEQGDEEASLGLPISPFMDRS APQLANLQESFISHIVGPLCNSYDSAGLMPGKWVEDSDESGDTDD PEEEEEEAPAPNEEETCENNESPKKKTFKRRKIYCQITQHLLQNHK MW | 116 |
| hPDE3B (Uniprot ID: Q13370) | MRRDERDAKAMRSLQPPDGAGSPPESLRNGYVKSCVSPLRQDPP RGFFFHLCRFCNVELRPPPASPQQPRRCSPFCRARLSLGALAAFVL ALLLGAEPESWAAGAAWLRTLLSVCSHSLSPLFSIACAFFFLTCFL TRTKRGPGPGRSCGSWWLLALPACCYLGDFLVWQWWSWPWGD GDAGSAAPHTPPEAAAGRLLLVLSCVGLLLTLAHPLRLRHCVLV LLLASFVWWVSFTSLGSLPSALRPLLSGLVGGAGCLLALGLDHFF QIREAPLHPRLSSAAEEKVPVIRPRRRSSCVSLGETAASYYGSCKIF RRPSLPCISREQMILWDWDLKQWYKPHYQNSGGGNGVDLSVLN EARNMVSDLLTDPSLPPQVISSLRSISSLMGAFSGSCRPKINPLTPF PGFYPCSEIEDPAEKGDRKLNKGLNRNSLPTPQLRRSSGTSGLLPV EQSSRWDRNNGKRPHQEFGISSQGCYLNGPPFNSNLLTIPKQRSSS VSLTHHVGLRRAGVLSSLSPVNSSNHGPVSTGSLTNRSPIEFPDTA DFLNKPSVILQRSLGNAPNTPDFYQQLRNSDSNLCNSCGHQMLK YVSTSESDGTDCCSGKSGEEENIFSKESFKLMETQQEEETEKKDSR KLFQEGDKWLTEEAQSEQQTNIEQEVSLDLILVEEYDSLIEKMSN WNFPIFELVEKMGEKSGRILSQVMYTLFQDTGLLEIFKIPTQQFMN YFRALENGYRDIPYHNRIHATDVLHAVWYLTTRPVPGLQQIHNG CGTGNETDSDGRINHGRIAYISSKSCSNPDESYGCLSSNIPALELM ALYVAAAMHDYDHPGRTNAFLVATNAPQAVLYNDRSVLENHH AASAWNLYLSRPEYNFLLHLDHVEFKRFRFLVIEAILATDLKKHF DFLAEFNAKANDVNSNGIEWSNENDRLLVCQVCIKLADINGPAK VRDLHLKWTEGIVNEFYEQGDEEANLGLPISPFMDRSSPQLAKLQ ESFITHIVGPLCNSYDAAGLLPGQWLEAEEDNDTESGDDEDGEEL DTEDEEMENNLNPKPPRRKSRRRIFCQLMHHLTENHKIWKEIVEE EEKCKADGNKLQVENSSLPQADEIQVIEEADEEE | 117 |
| hPDE3B Catalytic domain (Amino acid 713-1072 of PDE3B) | FKIPTQQFMNYFRALENGYRDIPYHNRIHATDVLHAVWYLTTRP VPGLQQIHNGCGTGNETDSDGRINHGRIAYISSKSCSNPDESYGCL SSNIPALELMALYVAAAMHDYDHPGRTNAFLVATNAPQAVLYN DRSVLENHHAASAWNLYLSRPEYNFLLHLDHVEFKRFRFLVIEAI LATDLKKHFDFLAEFNAKANDVNSNGIEWSNENDRLLVCQVCIK LADINGPAKVRDLHLKWIEGIVNEFYEQGDEEANLGLPISPFMDR SSPQLAKLQESFITHIVGPLCNSYDAAGLLPGQWLEAEEDNDILS GDDEDGEELD1EDEEMENNLNPKPPRRKSRRRIFCQLMHHLTEN HKIW | 118 |
| hPDE4A (Uniprot ID: P27815) | MEPPTVPSERSLSLSLPGPREGQATLKPPPQHLWRQPRTPIRIQQR GYSDSAERAERERQPHRPIERADAMDTSDRPGLRTTRMSWPSSFH GTGTGSGGAGGGSSRRFEAENGPTPSPGRSPLDSQASPGLVLHAG AATSQRRESFLYRSDSDYDMSPKTMSRNSSVTSEAHAEDLIVTPF AQVLASLRSVRSNFSLLTNVPVPSNKRSPLGGPTPVCKATLSEETC QQLARETLEELDWCLEQLETMQTYRSVSEMASHKFKRMLNREL THLSEMSRSGNQVSEYISTTFLDKQNEVEIPSPTMKEREKQQAPRP RPSQPPPPPVPHLQPMSQITGLKKLMHSNSLNNSNIPRFGVKTDQE ELLAQELENLNKWGLNIFCVSDYAGGRSLTCIMYMIFQERDLLK KFRIPVDTMVTYMLTLEDHYHADVAYHNSLHAADVLQSTHVLL ATPALDAVFTDLEILAALFAAAIHDVDHPGVSNQFLINTNSELAL MYNDESVLENHHLAVGFKLLQEDNCDIFQNLSKRQRQSLRKMVI DMVLATDMSKHMTLLADLKTMVETKKVTSSGVLLLDNYSDRIQ VLRNMVHCADLSNPTKPLELYRQWTDRIMAEFFQQGDRERERG MEISPMCDKHTASVEKSQVGFIDYIVHPLWETWADLVHPDAQEIL DTLEDNRDWYYSAIRQSPSPPPEEESRGPGHPPLPDKFQFELTLEE EEEEISMAQIPCTAQEALTAQGLSGVEEALDATIAWEASPAQESL EVMAQEASLEAELEAVYLTQQAQSTGSAPVAPDEFSSREEFVVA VSHSSPSALALQSPLLPAWRTLSVSEHAPGLPGLPSTAAEVEAQR EHQAAKRACSACAGTFGEDTSALPAPGGGGSGGDPT | 119 |

TABLE 4-continued

Sequences of human PDE proteins and their catalytic domains

| PDE protein (Uniprot ID or domain description) | Amino Acid sequence | AA SEQ ID NO. |
|---|---|---|
| hPDE4A Catalytic domain (Amino acid 330-723 of PDE4A) | QPMSQITGLKKLMHSNSLNNSNIPRFGVKTDQEELLAQELENLNK WGLNIFCVSDYAGGRSLTCIMYMIFQERDLLKKFRIPVDTMVTY MLTLEDHYHADVAYHNSLHAADVLQSTHVLLATPALDAVFTDL EILAALFAAAIHDVDHPGVSNQFLINTNSELALMYNDESVLENHH LAVGFKLLQEDNCDIFQNLSKRQRQSLRKMVIDMVLATDMSKH MTLLADLKTMVETKKVTSSGVLLLDNYSDRIQVLRNMVHCADL SNPTKPLELYRQWTDRIMAEFFQQGDRERERGMEISPMCDKHTA SVEKSQVGFIDYIVHPLWETWADLVHPDAQEILDTLEDNRDWYY SAIRQSPSPPPEEESRGPGHPPLPDKFQFELTLEEEEEEEISM | 120 |
| hPDE4B (Uniprot ID: Q07343) | MKKSRSVMTVMADDNVKDYFECSLSKSYSSSSNTLGIDLWRGRR CCSGNLQLPPLSQRQSERARTPEGDGISRPTTLPLTTLPSIAITTVSQ ECFDVENGPSPGRSPLDPQASSSAGLVLHATFPGHSQRRESFLYRS DSDYDLSPKAMSRNSSLPSEQHGDDLIVTPFAQVLASLRSVRNNF TILTNLHGTSNKRSPAASQPPVSRVNPQEESYQKLAMETLEELDW CLDQLETIQTYRSVSEMASNKFKRMLNRELTHLSEMSRSGNQVS EYISNTFLDKQNDVEIPSPTQKDREKKKQQLMTQISGVKKLMHS SSLNNTSISRFGVNIENEDHLAKELEDLNKWGLNIFNVAGYSHNR PLTCIMYAIFQERDLLKTFRISSDTFITYMMTLEDHYHSDVAYHNS LHAADVAQSTHVLLSTPALDAVFTDLEILAAIFAAAIHDVDHPGV SNQFLINTNSELALMYNDESVLENHHLAVGFKLLQEEHCDIFMNL TKKQRQTLRKMVIDMVLATDMSKHMSLLADLKTMVETKKVTSS GVLLLDNYTDRIQVLRNMVHCADLSNPTKSLELYRQWTDRIMEE FFQQGDKERERGMEISPMCDKHTASVEKSQVGFIDYIVHPLWET WADLVQPDAQDILDTLEDNRNWYQSMIPQSPSPPLDEQNRDCQG LMEKFQFELTLDEEDSEGPEKEGEGHSYFSSTKTLCVIDPENRDSL GETDIDIATEDKSPVDT | 121 |
| hPDE4B Catalytic domain (Amino acid 330-682 of PDE4B) | VNIENEDHLAKELEDLNKWGLNIFNVAGYSHNRPLTCIMYAIFQ ERDLLKTFRISSDTFITYMMTLEDHYHSDVAYHNSLHAADVAQS THVLLSTPALDAVFTDLEILAAIFAAAIHDVDHPGVSNQFLINTNS ELALMYNDESVLENHHLAVGFKLLQEEHCDIFMNLTKKQRQTLR KMVIDMVLATDMSKHMSLLADLKTMVETKKVTSSGVLLLDNYT DRIQVLRNMVHCADLSNPTKSLELYRQWTDRIMEEFFQQGDKER ERGMEISPMCDKHTASVEKSQVGFIDYIVHPLWETWADLVQPDA QDILDTLEDNRNWYQSMIPQSPSPPLDEQNRDCQGLMEKFQFEL | 122 |
| hPDE4C (Uniprot ID: Q08493) | MENLGVGEGAEACSRLSRSRGRHSMTRAPKHLWRQPRRPIRIQQ RFYSDPDKSAGCRERDLSPRPELRKSRLSWPVSSCRRFDLENGLS CGRRALDPQSSPGLGRIMQAPVPHSQRRESFLYRSDSDYELSPKA MSRNSSVASDLHGEDMIVTPFAQVLASLRTVRSNVAALARQQCL GAAKQGPVGNPSSSNQLPPAEDTGQKLALETLDELDWCLDQLET LQTRHSVGEMASNKFKRILNRELTHLSETSRSGNQVSEYISRTFLD QQTEVELPKVTAEEAPQPMSRISGLHGLCHSASLSSATVPRFGVQ TDQEEQLAKELEDTNKWGLDVFKVAELSGNRPLTAIIFSIFQERDL LKTFQIPADTLATYLLMLEGHYHANVAYHNSLHAADVAQSTHV LLATPALEAVFTDLEILAALFASAIHDVDHPGVSNQFLINTNSELA LMYNDASVLENHHLAVGFKLLQAENCDIFQNLSAKQRLSLRRM VIDMVLATDMSKHMNLLADLKTMVETKKVTSLGVLLLDNYSDR IQVLQNLVHCADLSNPTKPLPLYRQWTDRIMAEFFQQGDRERES GLDISPMCDKHTASVEKSQVGFIDYIAHPLWETWADLVHPDAQD LLDTLEDNREWYQSKIPRSPSDLTNPERDGPDRFQFELTLEEAEEE DEEEEEEGEETALAKEALELPDTELLSPEAGPDPGDLPLDNQRT | 123 |
| hPDE4C Catalytic domain (Amino acid 312-677 of PDE4C) | VQTDQEEQLAKELEDTNKWGLDVFKVAELSGNRPLTAIIFSIFQE RDLLKTFQIPADTLATYLLMLEGHYHANVAYHNSLHAADVAQST HVLLATPALEAVFTDLEILAALFASAIHDVDHPGVSNQFLINTNSE LALMYNDASVLENHHLAVGFKLLQAENCDIFQNLSAKQRLSLRR MVIDMVLATDMSKHMNLLADLKTMVETKKVTSLGVLLLDNYS DRIQVLQNLVHCADLSNPTKPLPLYRQWTDRIMAEFFQQGDRER ESGLDISPMCDKHTASVEKSQVGFIDYIAHPLWETWADLVHPDA QDLLDTLEDNREWYQSKIPRSPSDLTNPERDGPDRFQFELTLEEA EEDEEEEEEGE | 124 |
| hPDE4D (Uniprot ID: Q08499) | MEAEGSSAPARAGSGEGSDSAGGATLKAPKHLWRHEQHHQYPL RQPQFRLLHPHHHLPPPPPPSPQPQPQCPLQPPPPPPLPPPPPPPGAA RGRYASSGATGRVRHRGYSDTERYLYCRAMDRTSYAVETGHRP GLKKSRMSWPSSFQGLRRFDVDNGTSAGRSPLDPMTSPGSGLILQ ANFVHSQRRESFLYRSDSDYDLSPKSMSRNSSIASDIHGDDLIVTP FAQVLASLRTVRNNPAALTNLQDRAPSKRSPMCNQPSINKATITE EAYQKLASETLEELDWCLDQLETLQTRHSVSEMASNKFKRMLNR ELTHLSEMSRSGNQVSEFISNTFLDKQHEVEIPSPTQKEKEKKKRP MSQISGVKKLMHSSSLTNSSIPRFGVKTEQEDVLAKELEDVNKW | 125 |

TABLE 4-continued

Sequences of human PDE proteins and their catalytic domains

| PDE protein (Uniprot ID or domain description) | Amino Acid sequence | AA SEQ ID NO. |
|---|---|---|
| | GLHVFRIAELSGNRPLTVIMHTIFQERDLLKTFKIPVDTLITYLMTL EDHYHADVAYHNNIHAADVVQSTHVLLSTPALEAVFTDLEILAAI FASAIHDVDHPGVSNQFLINTNSELALMYNDSSVLENHHLAVGFK LLQEENCDIFQNLTKKQRQSLRKMVIDIVLATDMSKHMNLLADL KTMVETKKVTSSGVLLLDNYSDRIQVLQNMVHCADLSNPTKPLQ LYRQWTDRIMEEFFRQGDRERERGMEISPMCDKHNASVEKSQVG FIDYIVHPLWETWADLVHPDAQDILDTLEDNREWYQSTIPQSPSP APDDPEEGRQGQTEKFQFELTLEEDGESDTEKDSGSQVEEDTSCS DSKTLCTQDSESTEIPLDEQVEEEAVGEEEESQPEACVIDDRSPDT | |
| hPDE4D Catalytic domain (Amino acid 386-751 of PDE4D) | VKIEQEDVLAKELEDVNKWGLHVFRIAELSGNRPLTVIMHTIFQE RDLLKTFKIPVDTLITYLMTLEDHYHADVAYHNNIHAADVVQST HVLLSTPALEAVFTDLEILAAIFASAIHDVDHPGVSNQFLINTNSEL ALMYNDSSVLENHHLAVGFKLLQEENCDIFQNLTKKQRQSLRKM VIDIVLATDMSKHMNLLADLKTMVETKKVTSSGVLLLDNYSDRI QVLQNMVHCADLSNPTKPLQLYRQWTDRIMEEFFRQGDRERER GMEISPMCDKHNASVEKSQVGFIDYIVHPLWETWADLVHPDAQD ILDTLEDNREWYQSTIPQSPSPAPDDPEEGRQGQTEKFQFELTLEE DGESDTEKD | 126 |
| hPDE6A (Uniprot ID: P16499) | MGEVTAEEVEKFLDSNIGFAKQYYNLHYRAKLISDLLGAKEAAV DFSNYHSPSSMEESEIIFDLLRDFQENLQTEKCIFNVMKKLCFLLQ ADRMSLFMYRTRNGIAELATRLFNVHKDAVLEDCLVMPDQEIVF PLDMGIVGHVAHSKKIANVPNTEEDEHFCDFVDILTEYKTKNILA SPIMNGKDVVAIIMAVNKVDGSHFTKRDEEILLKYLNFANLIMKV YHLSYLHNCETRRGQILLWSGSKVFEELTDIERQFHKALYTVRAF LNCDRYSVGLLDMTKQEFFDVWPVLMGEVPPYSGPRTPDGREI NFYKVIDYILHGKEDIKVIPNPPPDHWALVSGLPAYVAQNGLICNI MNAPAEDFFAFQKEPLDESGWMIKNVLSMPIVNKKEEIVGVATF YNRKDGKPFDEMDETLMESLTQFLGWSVLNPDTYESMNKLENR KDIFQDIVKYHVKCDNEEIQKILKTREVYGKEPWECEEEELAEILQ AELPDADKYEINKFHFSDLPLTELELVKCGIQMYYELKVVDKFHI PQEALVRFMYSLSKGYRKITYHNWRHGFNVGQTMFSLLVTGKL KRYFTDLEALAMVTAAFCHDIDHRGTNNLYQMKSQNPLAKLHG SSILERHHLEFGKTLLRDESLNIFQNLNRRQHEHAIHMMDIAIIAT DLALYFKKRTMFQKIVDQSKTYESEQEWTQYMMLEQTRKEIVM AMMMTACDLSAITKPWEVQSQVALLVAAEFWEQGDLERTVLQQ NPIPMMDRNKADELPKLQVGFIDFVCTFVYKEFSRFHEEITPMLD GITNNRKEWKALADEYDAKMKVQEEKKQKQQSAKSAAAGNQP GGNPSPGGATTSKSCCIQ | 127 |
| hPDE6A Catalytic domain (Amino acid 483-819 of PDE6A) | EEEELAEILQAELPDADKYEINKFHFSDLPLTELELVKCGIQMYYE LKVVDKFHIPQEALVRFMYSLSKGYRKITYHNWRHGFNVGQTM FSLLVTGKLKRYFTDLEALAMVTAAFCHDIDHRGTNNLYQMKSQ NPLAKLHGSSILERHHLEFGKTLLRDESLNIFQNLNRRQHEHAIH MMDIAIIATDLALYFKKRTMFQKIVDQSKTYESEQEWTQYMMLE QTRKEIVMAMMMTACDLSAITKPWEVQSQVALLVAAEFWEQGD LERTVLQQNPIPMMDRNKADELPKLQVGFIDFVCTFVYKEFSRFH EEITPMLDGITNNRKEWKALADEYDAK | 128 |
| hPDE6B (Uniprot ID: P35913) | MSLSEEQARSFLDQNPDFARQYFGKKLSPENVAAACEDGCPPDC DSLRDLCQVEESTALLELVQDMQESINMERVVFKVLRRLCTLLQ ADRCSLFMYRQRNGVAELATRLFSVQPDSVLEDCLVPPDSEIVFP LDIGVVGHVAQTKKMVNVEDVAECPHFSSFADELTDYKTKNML ATPIMNGKDVVAVIMAVNKLNGPFFTSEDEDVFLKYLNFATLYL KIYHLSYLHNCETRRGQVLLWSANKVFEELTDIERQFHKAFYTVR AYLNCERYSVGLLDMTKEKEFFDVWSVLMGESQPYSGPRTPDGR EIVFYKVIDYVLHGKEEIKVIPTPSADHWALASGLPSYVAESGFIC NIMNASADEMFKFQEGALDDSGWLIKNVLSMPIVNKKEEIVGVA TFYNRKDGKPFDEQDEVLMESLTQFLGWSVMNTDTYDKMNKLE NRKDIAQDMVLYHVKCDRDEIQLILPTRARLGKEPADCDEDELG EILKEELPGPTTFDIYEFHFSDLECTELDLVKCGIQMYYELGVVRK FQIPQEVLVRFLFSISKGYRRITYHNWRHGFNVAQTMFTLLMTGK LKSYYTDLEAFAMVTAGLCHDIDHRGTNNLYQMKSQNPLAKLH GSSILERHHLEFGKFLLSEETLNIYQNLNRRQHEHVIHLMDIAIIAT DLALYFKKRAMFQKIVDESKNYQDKKSWVEYLSLETTRKEIVMA MMMTACDLSAITKPWEVSKAVLLVAAEFWEQGDLERTVLDQQ PIPMMDRNKAAELPKLQVGFIDFVCTFVYKEFSRFHEEILPMFDRL QNNRKEWKALADEYEAKVKALEEKEEEERVAAKKVGTEICNGG PAPKSSTCCIL | 129 |

TABLE 4-continued

Sequences of human PDE proteins and their catalytic domains

| PDE protein (Uniprot ID or domain description) | Amino Acid sequence | AA SEQ ID NO. |
|---|---|---|
| hPDE6B Catalytic domain (Amino acid 476-817 of PDE6B) | PADCDEDELGEILKEELPGPTTFDIYEFHFSDLECTELDLVKCGIQ MYYELGVVRKFQIPQEVLVRFLFSISKGYRRITYHNWRHGFNVA QTMFTLLMTGKLKSYYTDLEAFAMVTAGLCHDIDHRGTNNLYQ MKSQNPLAKLHGSSILERHHLEFGKFLLSEETLNIYQNLNRRQHE HVIHLMDIAIIATDLALYFKKRAMFQKIVDESKNYQDKKSWVEY LSLETTRKEIVMAMMMTACDLSAITKPWEVQSKVALLVAAEFW EQGDLERTVLDQQPIPMMDRNKAAELPKLQVGFIDFVCTFVYKE FSRFHEEILPMFDRLQNNRKEWKALADEYEAK | 130 |
| hPDE6C (Uniprot ID: P51160) | MGEINQVAVEKYLEENPQFAKEYFDRKLRVEVLGEIFKNSQVPV QSSMSFSELTQVEESALCLELLWTVQEEGGTPEQGVHRALQRLA HLLQADRCSMFLCRSRNGIPEVASRLLDVTPTSKFEDNLVGPDKE VVFPLDIGIVGWAAHTKKTHNVPDVKKNSHFSDFMDKQTGYVT KNLLATPIVVGKEVLAVIMAVNKVNASEFSKQDEEVFSKYLNFV SIILRLHHTSYMYNIESRRSQILMWSANKVFEELTDVERQFHKAL YTVRSYLNCERYSIGLLDMTKEKEFYDEWPIKLGEVEPYKGPKTP DGREVNFYKIIDYILHGKEEIKVIPTPPADHWTLISGLPTYVAENGF ICNMMNAPADEYFTFQKGPVDETGWVIKNVLSLPIVNKKEDIVG VATFYNRKDGKPFDEHDEYITETLTQFLGWSLLNTDTYDKMNKL ENRKDIAQEMLMNQTKATPEEIKSILKFQEKLNVDVIDDCEEKQL VAILKEDLPDPRSAELYEFRFSDFPLTEHGLIKCGIRLFFEINVVEK FKVPVEVLTRWMYTVRKGYRAVTYHNWRHGFNVGQTMFTLLM TGRLKKYYTDLEAFAMLAAAFCHDIDHRGTNNLYQMKSTSPLA RLHGSSILERHHLEYSKTLLQDESLNIFQNLNKRQFETVIHLFEVAI IATDLALYFKKRTMFQKIVDACEQMQTEEEAIKYVTVDPTKKEII MAMMMTACDLSAITKPWEVQSQVALMVANEFWEQGDLERTVL QQQPIPMMDRNKRDELPKLQVGFIDFVCTFVYKEFSRFHKEITPM LSGLQNNRVEWKSLADEYDAKMKVIEEEAKKQEGGAEKAAEDS GGGDDKKSKTCLML | 131 |
| hPDE6C Catalytic domain (Amino acid 483-822 of PDE6C) | DDCEEKQLVAILKEDLPDPRSAELYEFRFSDFPLTEHGLIKCGIRLF FEINVVEKFKVPVEVLTRWMYTVRKGYRAVTYHNWRHGFNVG QTMFTLLMTGRLKKYYTDLEAFAMLAAAFCHDIDHRGTNNLYQ MKSTSPLARLHGSSILERHHLEYSKTLLQDESLNIFQNLNKRQFET VIHLFEVAIIATDLALYFKKRTMFQKIVDACEQMQTEEEAIKYVT VDPTKKEIIMAMMMTACDLSAITKPWEVQSQVALMVANEFWEQ GDLERTVLQQQPIPMMDRNKRDELPKLQVGFIDFVCTFVYKEFSR FHKEITPMLSGLQNNRVEWKSLADEYDAK | 132 |
| hPDE7A (Uniprot ID: Q13946) | MEVCYQLPVLPLDRPVPQHVLSRRGAISFSSSSALFGCPNPRQLSQ RRGAISYDSSDQTALYIRMLGDVRVRSRAGFESERRGSHPYIDFRI FHSQSEIEVSVSARNIRRLLSFQRYLRSSRFFRGTAVSNSLNILDDD YNGQAKCMLEKVGNWNFDIFLFDRLTNGNSLVSLTFHLFSLHGLI EYFHLDMMKLRRFLVMIQEDYHSQNPYHNAVHAADVTQAMHC YLKEPKLANSVTPWDILLSLIAAATHDLDHPGVNQPFLIKTNHYL ATLYKNTSVLENHHWRSAVGLLRESGLFSHLPLESRQQMETQIG ALILATDISRQNEYLSLFRSHLDRGDLCEDTRHRHLVLQMALKC ADICNPCRTWELSKQWSEKVTEEFFHQGDIEKKYHLGVSPLCDR HTESIANIQIGFMTYLVEPLFTEWARFSNTRLSQTMLGHVGLNKA SWKGLQREQSSSEDTDAAFELNSQLLPQENRLS | 133 |
| hPDE7A Catalytic domain (Amino acid 187-451 of PDE7A) | FHLDMMKLRRFLVMIQEDYHSQNPYHNAVHAADVTQAMHCYL KEPKLANSVTPWDILLSLIAAATHDLDHPGVNQPFLIKTNHYLAT LYKNTSVLENHHWRSAVGLLRESGLFSHLPLESRQQMETQIGALI LATDISRQNEYLSLFRSHLDRGDLCEDTRHRHLVLQMALKCADI CNPCRTWELSKQWSEKVTEEFFHQGDIEKKYHLGVSPLCDRHTE SIANIQIGFMTYLVEPLFTEWARFSNTRLSQTMLGHVGLNKASW | 134 |
| hPDE7B (Uniprot ID: Q9NP56) | MSCLMVERCGEILFENPDQNAKCVCMLGDIRLRGQTGVRAERRG SYPFIDFRLLNSTTYSGEIGTKKKVKRLLSFQRYFHASRLLRGIIPQ APLHLLDEDYLGQARHMLSKVGMWDFDIFLFDRLTNGNSLVTLL CHLFNTHGLIHHFKLDMVTLHRFLVMVQEDYHSQNPYHNAVHA ADVTQAMHCYLKEPKLASFLTPLDIMLGLLAAAAHDVDHPGVN QPFLIKTNHHLANLYQNMSVLENHHWRSTIGMLRESRLLAHLPK EMTQDIEQQLGSLILATDINRQNEFLTRLKAHLHNKDLRLEDAQD RHFMLQIALKCADICNPCRIWEMSKQWSERVCEEFYRQGELEQK FELEISPLCNQQKDSIPSIQIGFMSYIVEPLFREWAHFTGNSTLSEN MLGHLAHNKAQWKSLLPRQHRSRGSSGSGPDHDHAGQGTESEE QEGDSP | 135 |

TABLE 4-continued

Sequences of human PDE proteins and their catalytic domains

| PDE protein (Uniprot ID or domain description) | Amino Acid sequence | AA SEQ ID NO. |
|---|---|---|
| hPDE7B Catalytic domain (Amino acid 172-410 of PDE7B) | YHNAVHAADVTQAMHCYLKEPKLASFLTPLDIMLGLLAAAAHD VDHPGVNQPFLIKTNHHLANLYQNMSVLENHHWRSTIGMLRESR LLAHLPKEMTQDIEQQLGSLILATDINRQNEFLTRLKAHLHNKDL RLEDAQDRHFMLQIALKCADICNPCRIWEMSKQWSERVCEEFYR QGELEQKFELEISPLCNQQKDSIPSIQIGFMSYIVEPLFREWAHFTG NSTLSENMLGHLAHNK | 136 |
| hPDE8A (Uniprot ID: O60658) | MGCAPSIHISERLVAEDAPSPAAPPLSSGGPRLPQGQKTAALPRTR GAGLLESELRDSGKKVAVADVQFGPMRFHQDQLQVLLVFTKE DNQCNGFCRACEKAGFKCTVTKEAQAVLACFLDKHHDIIIIDHRN PRQLDAEALCRSIRSSKLSENTVIVGVVRRVDREELSVMPFISAGF TRRYVENPNIMACYNELLQLEFGEVRSQLKLRACNSVFTALENSE DAIEITSEDRFIQYANPAFETTMGYQSGELIGKELGEVPINEKKAD LLDTINSCIRIGKEWQGIYYAKKKNGDNIQQNVKIIPVIGQGGKIR HYVSIIRVCNGNNKAEKISECVQSDTHTDNQTGKHKDRRKGSLD VKAVASRATEVSSQRRHSSMARIHSMTIEAPITKVINIINAAQESSP MPVTEALDRVLEILRTIELYSPQFGAKDDDPHANDLVGGLMSDG LRRLSGNEYVLSTKNTQMVSSNIITPISLDDVPPRIARAMENEEYW DFDIFELEAATHNRPLIYLGLKMFARFGICEFLHCSESTLRSWLQII EANYHSSNPYHNSTHSADVLHATAYFLSKERIKETLDPIDEVAALI AATIHDVDHPGRTNSFLCNAGSELAILYNDTAVLESHHAALAFQL TTGDDKCNIFKNMERNDYRTLRQGIIDMVLATEMTKHFEHVNKF VNSINKPLATLEENGETDKNQEVINTMLRTPENRTLIKRMLIKCA DVSNPCRPLQYCIEWAARISEEYFSQTDEEKQQGLPVVMPVFDRN TCSIPKSQISFIDYFITDMFDAWDAFVDLPDLMQHLDNNFKYWKG LDEMKLRNLRPPPE | 137 |
| hPDE8A Catalytic domain (Amino acid 531-813 of PDE8A) | LHCSESTLRSWLQIIEANYHSSNPYHNSTHSADVLHATAYFLSKE RIKETLDPIDEVAALIAATIHDVDHPGRTNSFLCNAGSELAILYND TAVLESHHAALAFQLTTGDDKCNIFKNMERNDYRTLRQGIIDMV LATEMTKHFEHVNKFVNSINKPLATLEENGETDKNQEVINTMLR TPENRTLIKRMLIKCADVSNPCRPLQYCIEWAARISEEYFSQTDEE KQQGLPVVMPVFDRNTCSIPKSQISFIDYFITDMFDAWDAFVDLP DLMQHLDNNFKYW | 138 |
| hPDE8B (Uniprot ID: O95263) | MGCAPSIHVSQSGVIYCRDSDESSSPRQTTSVSQGPAAPLPGLFVQ TDAADAIPPSRASGPPSVARVRRARIELGSGSSAGSAAPAATTSR GRRRHCCSSAEAETQTCYTSVKQVSSAEVRIGPMRLTQDPIQVLLI FAKEDSQSDGFWWACDRAGYRCNIARTPESALECFLDKHHEIIVI DHRQTQNFDAEAVCRSIRATNPSEHTVILAVVSRVSDDHEEASVL PLLHAGFNRRFMENSSIIACYNELIQIEHGEVRSQFKLRACNSVFT ALDHCHEAIEITSDDHVIQYVNPAFERMMGYHKGELLGKELADL PKSDKNRADLLDTINTCIKKGKEWQGVYYARRKSGDSIQQHVKI TPVIGQGGKIRHFVSLKKLCCTTDNNKQIHKIHRDSGDNSQIEPHS FRYKNRRKESIDVKSISSRGSDAPSLQNRRYPSMARIHSMTIEAPIT KVINIINAAQENSPVTVAEALDRVLEILRTTELYSPQLGTKDEDPH TSDLVGGLMTDGLRRLSGNEYVFTKNVHQSHSHLAMPITINDVPP CISQLLDNEESWDFNIFELEAITHKRPLVYLGLKVFSRFGVCEFLN CSETTLRAWFQVIEANYHSSNAYHNSTHAADVLHATAFFLGKER VKGSLDQLDEVAALIAATVHDVDHPGRTNSFLCNAGSELAVLYN DTAVLESHHTALAFQLTVKDTKCNIFKNIDRNHYRTLRQAIIDMV LATEMTKHFEHVNKFVNSINKPMAAEIEGSDCECNPAGKNFPEN QILIKRMMIKCADVANPCRPLDLCIEWAGRISEEYFAQTDEEKRQ GLPVVMPVFDRNTCSIPKSQISFIDYFITDMFDAWDAFAHLPALM QHLADNYKHWKTLDDLCKSLRLPSDS | 139 |
| hPDE8B Catalytic domain (Amino acid 590-868 of PDE8B) | LNCSETTLRAWFQVIEANYHSSNAYHNSTHAADVLHATAFFLGK ERVKGSLDQLDEVAALIAATVHDVDHPGRTNSFLCNAGSELAVL YNDTAVLESHHTALAFQLTVKDTKCNIFKNIDRNHYRTLRQAIID MVLATEMTKHFEHVNKFVNSINKPMAAEIEGSDCECNPAGKNFP ENQILIKRMMIKCADVANPCRPLDLCIEWAGRISEEYFAQTDEEK RQGLPVVMPVFDRNTCSIPKSQISFIDYFITDMFDAWDAFAHLPAL MQHLADNYKHW | 140 |
| hPDE9A (Uniprot ID: O76083) | MGSGSSSYRPKAIYLDIDGRIQKVIFSKYCNSSDIMDLFCIATGLPR NTTISLLTTDDAMVSIDPTMPANSERTPYKVRPVAIKQLSAGVED KRTTSRGQSAERPLRDRRVVGLEQPRREGAFESGQVEPRPREPQG CYQEGQRIPPEREELIQSVLAQVAEQFSRAFKINELKAEVANHLA VLEKRVELEGLKVVEIEKCKSDIKKMREELAARSSRTNCPCKYSF LDNHKKLTPRRDVPTYPKYLLSPETIEALRKPTFDVWLWEPNEM LSCLEHMYHDLGLVRDFSINPVTLRRWLFCVHDNYRNNPFHNFR HCFCVAQMMYSMVWLCSLQEKFSQTDILILMTAAICHDLDHPGY NNTYQINARIELAVRYNDISPLENHHCAVAFQILAEPECNIFSNIPP | 141 |

TABLE 4-continued

Sequences of human PDE proteins and their catalytic domains

| PDE protein (Uniprot ID or domain description) | Amino Acid sequence | AA SEQ ID NO. |
|---|---|---|
| | DGFKQIRQGMITLILATDMARHAEIMDSFKEKMENFDYSNEEHM TLLKMILIKCCDISNEVRPMEVAEPWVDCLLEEYFMQSDREKSEG LPVAPFMDRDKVTKATAQIGFIKFVLIPMFETVTKLFPMVEEIML QPLWESRDRYEELKRIDDAMKELQKKTDSLTSGATEKSRERSRD VKNSEGDCA | |
| hPDE9A Catalytic domain (Amino acid 288-550 of PDE9A) | FSINPVTLRRWLFCVHDNYRNNPFHNFRHCFCVAQMMYSMVWL CSLQEKFSQTDILILMTAAICHDLDHPGYNNTYQINARTELAVRY NDISPLENHHCAVAFQILAEPECNIFSNIPPDGFKQIRQGMITLILAT DMARHAEIMDSFKEKMENFDYSNEEHMTLLKMILIKCCDISNEV RPMEVAEPWVDCLLEEYFMQSDREKSEGLPVAPFMDRDKVTKA TAQIGFIKFVLIPMFETVTKLFPMVEEIMLQPLWESRDRY | 142 |
| hPDE10A (Uniprot ID: Q9Y233) | MRIEERKSQHLTGLTDEKVKAYLSLHPQVLDEFVSESVSAETVEK WLKRKNNKSEDESAPKEVSRYQDTNMQGVVYELNSYIEQRLDT GGDNQLLLYELSSIIKIATKADGFALYFLGECNNSLCIFTPPGIKEG KPRLIPAGPITQGTTVSAYVAKSRKTLLVEDILGDERFPRGTGLES GTRIQSVLCLPIVTAIGDLIGILELYRHWGKEAFCLSHQEVATANL AWASVAIHQVQVCRGLAKQIELNDFLLDVSKTYFDNIVAIDSLLE HIMIYAKNLVNADRCALFQVDHKNKELYSDLFDIGEEKEGKPVF KKTKEIRFSIEKGIAGQVARTGEVLNIPDAYADPRFNREVDLYTG YTTRNILCMPIVSRGSVIGVVQMVNKISGSAFSKTDENNFKMFAV FCALALHCANMYHRIRHSECIYRVTMEKLSYHSICTSEEWQGLM QFTLPVRLCKEIELFHFDIGPFENMWPGIFVYMVHRSCGTSCFELE KLCRFIMSVKKNYRRVPYHNWKHAVTVAHCMYAILQNNHTLFT DLERKGLLIACLCHDLDHRGFSNSYLQKFDHPLAALYSTSTMEQ HHFSQTVSILQLEGHNIFSTLSSSEYEQVLEIIRKAIIATDLALYFGN RKQLEEMYQTGSLNLNNQSHRDRVIGLMMTACDLCSVTKLWPV TKLTANDIYAEFWAEGDEMKKLGIQPIPMMDRDKKDEVPQGQL GFYNAVAIPCYTTLTQILPPTEPLLKACRDNLSQWEKVIRGEETAT WISSPSVAQKAAASED | 143 |
| hPDE10A Catalytic domain (Amino acid 458-760 of PDE10A) | CKEIELFHFDIGPFENMWPGIFVYMVHRSCGTSCFELEKLCRFIMS VKKNYRRVPYHNWKHAVTVAHCMYAILQNNHTLFTDLERKGLL IACLCHDLDHRGFSNSYLQKFDHPLAALYSTSTMEQHHFSQTVSI LQLEGHNIFSTLSSSEYEQVLEIIRKAIIATDLALYFGNRKQLEEMY QTGSLNLNNQSHRDRVIGLMMTACDLCSVTKLWPVTKLTANDIY AEFWAEGDEMKKLGIQPIPMMDRDKKDEVPQGQLGFYNAVAIP CYTTLTQILPPIEPLLKACRDNLSQWEKVIRGEE | 144 |
| hPDE11A (Uniprot ID: Q9HCR9) | MAASRLDFGEVETFLDRHPELFEDYLMRKGKQEMVEKWLQRHS QGQGALGPRPSLAGTSSLAHSTCRGGSSVGGGTGPNGSAHSQPLP GGGDCGGVPLSPSWAGGSRGDGNLQRRASQKELRKSFARSKAIH VNRTYDEQVTSRAQEPLSSVRRRALLRKASSLPPTTAHILSALLES RVNLPRYPPTAIDYKCHLKKHNERQFFLELVKDISNDLDLTSLSY KILIFVCLMVDADRCSLFLVEGAAAGKKTLVSKFFDVHAGTPLLP CSSTENSNEVQVPWGKGIIGYVGEHGETVNIPDAYQDRRFNDEID KLTGYKTKSLLCMPIRSSDGEIIGVAQAINKIPEGAPFTEDDEKVM QMYLPFCGIAISNAQLFAASRKEYERSRALLEVVNDLFEEQTDLE KIVKKIMHRAQTLLKCERCSVLLLEDIESPVVKFTKSFELMSPKCS ADAENSFKESMEKSSYSDWLINNSIAELVASTGLPVNISDAYQDP RFDAEADQISGFHIRSVLCVPIWNSNHQIIGVAQVLNRLDGKPFDD ADQRLFEAFVIFCGLGINNTIMYDQVKKSWAKQSVALDVLSYHA TCSKAEVDKFKAANIPLVSELAIDDIHFDDFSLDVDAMITAALRM FMELGMVQKFKIDYETLCRWLLTVRKNYRMVLYHNWRHAFNV CQLMFAMLTTAGFQDILTEVEILAVIVGCLCHDLDHRGTNNAFQ AKSGSALAQLYGTSATLEHHHFNHAVMILQSEGHNIFANLSSKEY SDLMQLLKQSILATDLTLYFERRIEFFELVSKGEYDWNIKNHRDI FRSMLMTACDLGAVTKPWEISRQVAELVTSEFFEQGDRERLELK LTPSAIFDRNRKDELPRLQLEWIDSICMPLYQALVKVNVKLKPML DSVATNRSKWEELHQKRLLASTASSSPASVMVAKEDRN | 145 |
| hPDE11A Catalytic Domain (Amino acid 640-905 of PDE11A) | FKIDYETLCRWLLTVRKNYRMVLYHNWRHAFNVCQLMFAMLT TAGFQDILTEVEILAVIVGCLCHDLDHRGTNNAFQAKSGSALAQL YGTSATLEHHHFNHAVMILQSEGHNIFANLSSKEYSDLMQLLKQS ILATDLTLYFERRTEFFELVSKGEYDWNIKNHRDIFRSMLMTACD LGAVTKPWEISRQVAELVTSEFFEQGDRERLELKLTPSAIFDRNRK DELPRLQLEWIDSICMPLYQALVKVNVKLKPMLDSVATNRSKW | 146 |

In some embodiments, the hPDE5 derived destabilizing domains may be derived from variants, and/or isoforms of hPDE5. The three isoforms hPDE5 Isoform 1, hPDE5 Isoform 2, and hPDE5 Isoform 3 differ at their N terminal regions, and all 3 have unique first exons followed by a common sequence of 823 amino acids. Accordingly, hPDE5 derived DDs may be derived from hPDE5 Isoform 1 (SEQ ID NO. 1; encoded by the nucleotide sequence of SEQ ID NO. 2; hPDE5 Isoform 2 (SEQ ID NO. 147; encoded by the nucleotides 113-2611 of the nucleotide sequence of SEQ ID NO. 148 or the nucleotide sequence of SEQ ID NO. 380) and/or hPDE5 Isoform 3 (SEQ ID NO. 149; encoded by the nucleotides 95-2563 of nucleotide sequence of SEQ ID NO. 150 or SEQ ID NO. 381). In some embodiments, the hPDE5 DDs may be derived from hPDE5 Isoform X1 (SEQ ID NO. 382).

In some embodiments, the DD mutations identified herein may be mapped back to the hPDE5 sequence to identify DD hotspots. DD hotspots as used herein refer to amino acids within the hPDE5 of SEQ ID NO. 1 whose mutation results in the "responsive" nature of the stimulus responsive element generated from hPDE5. The DD characteristics may be improved by saturation mutagenesis, which involves mutating the amino acids at the hotspot position to any of the known amino acids, including, but not limited to lysine, aspartic acid, glutamic acid, glutamine, asparagine, histidine, serine, threonine, tyrosine, cysteine, methionine, tryptophan, alanine, isoleucine, leucine, phenylalanine, valine, proline, and glycine. In some instances, a library of hotspot mutations may be generated by site directed mutagenesis and each of the mutants in the library is fused to a reporter protein e.g. AcGFP (SEQ ID NO. 79) via a linker such as SG. The properties of the DDs may be analyzed in the presence and absence of ligands such as Sildenafil, Vardenafil and Tadalafil. In some embodiments, the arginine at position 732 (also referred to as R732) of the hPDE5 of SEQ ID NO. 1, may be mutated to any of the known amino acids and are provided in Table 5A. The mutations of the amino acid R732 may include but are not limited to R732L, R732A, R732G, R732V, R732I, R732P, R732F, R732W, R732Y, R732H, R732S, R732T, R732D, R732E, R732Q, R732N, R732M, R732C, and R732K. The hPDE5 mutants fused either at the N terminus or the C terminus to a linker and GFP are provided in Table 6. In Table 5A, the mutations are in bold. Table 5B provides the additional components that may be combined with the mutants listed in Table 5A to generate the constructs described in Table 6. In Table 6, asterisk indicates the translation of the stop codon. Table 6 also provides alternate aliases for a given construct ID. These aliases are identified by the prefix OT.

TABLE 5A hPDE5 R732 mutants

| Construct ID/ Description | Sequence | AA SEQ ID NO. | NA SEQ ID NO. |
|---|---|---|---|
| hPDE5 (Amino acid 590-836 of WT, R732G) | MKHEVLCRWILSVKKNYRKNVAYHNWRHAFNTAQCAVA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRGGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 151 | 169 |
| hPDE5 (Amino acid 590-836 of WT, R732A) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRAGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 152 | 170 |
| hPDE5 (Amino acid 590-836 of WT, R732V) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRVGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 153 | 171 |
| hPDE5 (Amino acid 590-836 of WT, R732I) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRIGEFFELIRKNQFNLEDPHQKELF LAMLMTACDLSAITKPWPIQQRIAELVATEFFDQGDRERKE LNIEPTDLMNREKKNKIPSMQVGFIDAICLQLYEALTHVS | 154 | 172 |
| hPDE5 (Amino acid 590-836 of WT, R732P) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRPGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 155 | 173 |
| hPDE5 (Amino acid 590-836 of WT, R732F) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRFGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 156 | 174 |

TABLE 5A-continued hPDE5 R732 mutants

| Construct ID/ Description | Sequence | AA SEQ ID NO. | NA SEQ ID NO. |
|---|---|---|---|
| hPDE5 (Amino acid 590-836 of WT, R732W) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRWGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 157 | 175 |
| hPDE5 (Amino acid 590-836 of WT, R732Y) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRYGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 158 | 176 |
| hPDE5 (Amino acid 590-836 of WT, R732H) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRHGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 159 | 177 |
| hPDE5 (Amino acid 590-836 of WT, R732S) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRSGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 160 | 178 |
| hPDE5 (Amino acid 590-836 of WT, R732T) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRTGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 161 | 179 |
| hPDE5 (Amino acid 590-836 of WT, R732D) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRDGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 162 | 180 |
| hPDE5 (Amino acid 590-836 of WT, R732E) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKREGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 163 | 181 |
| hPDE5 (Amino acid 590-836 of WT, R732Q) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRQGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 164 | 182 |
| hPDE5 (Amino acid 590-836 of WT, R732N) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRNGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 165 | 183 |
| hPDE5 (Amino acid 590-836 of WT, R732M) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRMGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 166 | 184 |

TABLE 5A-continued hPDE5 R732 mutants

| Construct ID/ Description | Sequence | AA SEQ ID NO. | NA SEQ ID NO. |
|---|---|---|---|
| hPDE5 (Amino acid 590-836 of WT, R732C) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRCGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 167 | 185 |
| hPDE5 (Amino acid 590-836 of WT, R732K) | MKHEVLCRWILSVKKNYRKNVAYHNWRHAFNTAQCMFA ALKAGKIQNKLTDLEILALLIAALSHDLDHRGVNNSYIQRSE HPLAQLYCHSIMEHHHFDQCLMILNSPGNQILSGLSIEEYKT TLKIIKQAILATDLALYIKRKGEFFELIRKNQFNLEDPHQKEL FLAMLMTACDLSAITKPWPIQQRIAELVATEFFDQGDRERK ELNIEPTDLMNREKKNKIPSMQVGFIDAICLQLYEALTHVS | 168 | 186 |
| hPDE5 (Amino acid 535-860 of WT, R732G) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRGGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 383 | 401; 402 |
| hPDE5 (Amino acid 535-860 of WT, R732A) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRAGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 384 | 403; 404 |
| hPDE5 (Amino acid 535-860 of WT, R732L) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRLGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 12 | 405 |
| hPDE5 (Amino acid 535-860 of WT, R732V) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRVGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 385 | 406; 407 |
| hPDE5 (Amino acid 535-860 of WT, R732I) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRIGEFFELIRKNQ FNLEDPHQKELFLAMLMTACDLSAITKPWPIQQRIAELVATE FFDQGDRERKELNIEPTDLMNREKKNKIPSMQVGFIDAICLQ LYEALTHVSEDCFPLLDGCRKNRQKWQALAEQQ | 386 | 408 |
| hPDE5 (Amino acid 535-860 of WT, R732P) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRPGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 387 | 409; 410 |

TABLE 5A-continued hPDE5 R732 mutants

| Construct ID/ Description | Sequence | AA SEQ ID NO. | NA SEQ ID NO. |
|---|---|---|---|
| hPDE5 (Amino acid 535-860 of WT, R732F) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRFGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 388 | 411 |
| hPDE5 (Amino acid 535-860 of WT, R732W) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRWGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 389 | 412 |
| hPDE5 (Amino acid 535-860 of WT, R732Y) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRYGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 390 | 413; 414 |
| hPDE5 (Amino acid 535-860 of WT, R732H) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRHGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 391 | 415; 416 |
| hPDE5 (Amino acid 535-860 of WT, R732S) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRSGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 392 | 417; 418 |
| hPDE5 (Amino acid 535-860 of WT, R732T) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRTGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 393 | 419 |
| hPDE5 (Amino acid 535-860 of WT, R732D) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRDGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 394 | 420; 421 |
| hPDE5 (Amino acid 535-860 of WT, R732E) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKREGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 395 | 422; 423 |

TABLE 5A-continued hPDE5 R732 mutants

| Construct ID/ Description | Sequence | AA SEQ ID NO. | NA SEQ ID NO. |
|---|---|---|---|
| hPDE5 (Amino acid 535-860 of WT, R732Q) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRQGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 396 | 424; 425 |
| hPDE5 (Amino acid 535-860 of WT, R732N) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRNGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 397 | 426 |
| hPDE5 (Amino acid 535-860 of WT, R732M) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRMGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 398 | 427 |
| hPDE5 (Amino acid 535-860 of WT, R732C) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRCGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 399 | 428 |
| hPDE5 (Amino acid 535-860 of WT, R732K) | EETRELQSLAAAVVPSAQTLKITDFSFSDFELSDLETALCTIR MFTDLNLVQNFQMKHEVLCRWILSVKKNYRKNVAYHNWR HAFNTAQCMFAALKAGKIQNKLTDLEILALLIAALSHDLDH RGVNNSYIQRSEHPLAQLYCHSIMEHHHFDQCLMILNSPGN QILSGLSIEEYKTTLKIIKQAILATDLALYIKRKGEFFELIRKN QFNLEDPHQKELFLAMLMTACDLSAITKPWPIQQRIAELVA TEFFDQGDRERKELNIEPTDLMNREKKNKIPSMQVGFIDAIC LQLYEALTHVSEDCFPLLDGCRKNRQKWQALAEQQ | 400 | 429 |

TABLE 5B

Additional hPDE5 R732 construct components

| Component | Amino Acid Sequence | AA SEQ ID NO | NA SEQ ID NO |
|---|---|---|---|
| AcGFP (Amino acid 2-239 of WT) | VSKGAELFTGIVPILIELNGDVNGHKFSVSGEGEGDA TYGKLTLKFICTTGKLPVPWPTLVTTLSYGVQCFSRY PDHMKQHDFFKSAMPEGYIQERTIFFEDDGNYKSRA EVKFEGDTLVNRIELTGTDFKEDGNILGNKMEYNYN AHNVYIMTDKAKNGIKVNFKIRHNIEDGSVQLADHY QQNTPIGDGPVLLPDNHYLSTQSALSKDPNEKRDHMI YFGFVTAAAITHGMDELYK | 79 | 372 |
| AcGFP (Amino acid 1-239 of WT) | MVSKGAELFTGIVPILIELNGDVNGHKFSVSGEGEGD ATYGKLTLKFICTTGKLPVPWPTLVTTLSYGVQCFSR YPDHMKQHDFFKSAMPEGYIQERTIFFEDDGNYKSR AEVKFEGDTLVNRIELTGTDFKEDGNILGNKMEYNY NAHNVYIMTDKAKNGIKVNFKIRHNIEDGSVQLADH YQQNTPIGDGPVLLPDNHYLSTQSALSKDPNEKRDH MIYFGFVTAAAITHGMDELYK | 365 | 373 |
| linker (SG) | SG | — | AGTGGT |
| linker (GS) | GS | — | GGATCC |

TABLE 6 hPDE5 R732 constructs

| Construct ID/ Description | Sequence | AA SEQ ID NO. | NA SEQ ID NO. |
|---|---|---|---|
| OT-hPDE5N-037 (OT-001233, OT-hPDE5-037) hPDE5 (Amino acid 590-836 of WT, R732G); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCMILNSPGNQILSGLSIEEYKTTLKIIK QAILATDLALYIKRGGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 187 | 205 |
| OT-hPDE5N-038 (OT-001234, OT-hPDE5-038) hPDE5 (Amino acid 590-836 of WT, R732A); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCMILNSPGNQILSGLSIEEYKTTLKIIK QAILATDLALYIKRAGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 188 | 206 |
| OT-hPDE5N-039 (OT-001235, OT-hPDE5-039) hPDE5 (Amino acid 590-836 of WT, R732V); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCMILNSPGNQILSGLSIEEYKTTLKIIK QAILATDLALYIKRVGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 189 | 207 |
| OT-hPDE5N-040 (OT-001236, OT-hPDE5-040) hPDE5 (Amino acid 590-836 of WT, R732I); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCMILNSPGNQILSGLSIEEYKTTLKIIK QAILATDLALYIKRIGEFFELIRKNQFNLEDPHQKELFLAMLM ACDLSAITKPWPIQQRIAELVATEFFDQGDRERKELNIEPTDLM NREKKNKIPSMQVGFIDAICLQLYEALTHVSSGVSKGAELFTGI VPILIELNGDVNGHKFSVSGEGEGDATYGKLTLKFICTTGKLP VPWPTLVTTLSYGVQCFSRYPDHMKQHDFFKSAMPEGYIQER TIFFEDDGNYKSRAEVKFEGDTLVNRIELTGTDFKEDGNILGN KMEYNYNAHNVYIMTDKAKNGIKVNFKIRHNIEDGSVQLADH YQQNTPIGDGPVLLPDNHYLSTQSALSKDPNEKRDHMIYFGF VTAAAITHGMDELYK* | 190 | 208 |
| OT-hPDE5N-041 (OT-001237, OT-hPDE5-041) hPDE5 (Amino acid 590-836 of WT, R732P); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCMILNSPGNQILSGLSIEEYKTTLKIIK QAILATDLALYIKRPGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 191 | 209 |

TABLE 6-continued hPDE5 R732 constructs

| Construct ID/ Description | Sequence | AA SEQ ID NO. | NA SEQ ID NO. |
|---|---|---|---|
| OT-hPDE5N-042 (OT-001238, OT-hPDE5-042) hPDE5 (Amino acid 590-836 of WT, R732F); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCLMILNSPGNQILSGLSIEEYKTTLKIIK QAILATDLALYIKRFGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 192 | 210 |
| OT-hPDE5N-043 (OT-001239, OT-hPDE5-043) hPDE5 (Amino acid 590-836 of WT, R732W); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCLMILNSPGNQILSGLSIEEYKTTLKIIK QAILATDLALYIKRWGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 193 | 211 |
| OT-hPDE5N-044 (OT-001240, OT-hPDE5-044) hPDE5 (Amino acid 590-836 of WT, R732Y); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCLMILNSPGNQILSGLSIEEYKTTLKIIK QAILATDLALYIKRYGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 194 | 212 |
| OT-hPDE5N-045 (OT-001241, OT-hPDE5-045) hPDE5 (Amino acid 590-836 of WT, R732H); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCLMILNSPGNQILSGLSIEEYKTTLKIIK QAILATDLALYIKRHGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 195 | 213 |
| OT-hPDE5N-046 (OT-001242, OT-hPDE5-046) hPDE5 (Amino acid 590-836 of WT, R732S); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCLMILNSPGNQILSGLSIEEYKTTLKIIK QAILATDLALYIKRSGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 196 | 214 |
| OT-hPDE5N-047 (OT-001243, OT-hPDE5-047) | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCLMILNSPGNQILSGLSIEEYKTTLKIIK QAILATDLALYIKRTGEFFELIRKNQFNLEDPHQKELFLAMLM | 197 | 215 |

TABLE 6-continued hPDE5 R732 constructs

| Construct ID/ Description | Sequence | AA SEQ ID NO. | NA SEQ ID NO. |
|---|---|---|---|
| hPDE5 (Amino acid 590-836 of WT, R732T); linker (SG); AcGFP (Amino acid 2-239 of WT); stop | TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | | |
| OT-hPDE5N-048 (OT-001244, OT-hPDE5-048) hPDE5 (Amino acid 590-836 of WT, R732D); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCLMILNSPGNQILSGLSIEEYKTTLKIIK QAILATDLALYIKRDGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 198 | 216 |
| OT-hPDE5N-049 (OT-001245, OT-hPDE5-049) hPDE5 (Amino acid 590-836 of WT, R732E); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCLMILNSPGNQILSGLSIEEYKTTLKIIK QAILATDLALYIKREGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 199 | 217 |
| OT-hPDE5N-050 (OT-001246, OT-hPDE5-050) hPDE5 (Amino acid 590-836 of WT, R732Q); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCLMILNSPGNQILSGLSIEEYKTTLKIIK QAILATDLALYIKRQGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 200 | 218 |
| OT-hPDE5N-051 (OT-001247, OT-hPDE5-051) hPDE5 (Amino acid 590-836 of WT, R732N); linker (SG); AcGFP (Amino acid 2-239 of WT); stop | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCLMILNSPGNQILSGLSIEEYKTTLKIIK QAILATDLALYIKRNGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE RTIFFEDDGNYKSRAEVKFEGDTLVNRIELTGTDFKEDGNILG NKMEYNYNAHNVYIMTDKAKNGIKVNFKIRHNIEDGSVQLA DHYQQNTPIGDGPVLLPDNHYLSTQSALSKDPNEKRDHMIYF GFVTAAAITHGMDELYK* | 201 | 219 |
| OT-hPDE5N-052 (OT-001248, OT-hPDE5-052) hPDE5 (Amino acid 590-836 of WT, R732M); | MKHEVLCRWILSVKKNYRKNVAYHNWRHAFNTAQCMFAAL KAGKIQNKLTDLEILALLIAALSHDLDHRGVNNSYIQRSEHPL AQLYCHSIMEHHHFDQCLMILNSPGNQILSGLSIEEYKTTLKIIK QAILATDLALYIKRMGEFFELIRKNQFNLEDPHQKELFLAMLM TACDLSAITKPWPIQQRIAELVATEFFDQGDRERKELNIEPTDL MNREKKNKIPSMQVGFIDAICLQLYEALTHVSSGVSKGAELFT GIVPILIELNGDVNGHKFSVSGEGEGDATYGKLTLKFICTTGKL PVPWPTLVTTLSYGVQCFSRYPDHMKQHDFFKSAMPEGYIQE | 202 | 220 |

TABLE 6-continued hPDE5 R732 constructs

| Construct ID/<br>Description | Sequence | AA<br>SEQ ID<br>NO. | NA<br>SEQ ID<br>NO. |
|---|---|---|---|
| linker (SG);<br>AcGFP<br>(Amino acid 2-<br>239 of WT);<br>stop | RTIFFEDDGNYKSRAEVKFEGDTLVNRIELTGTDFKEDGNILG<br>NKMEYNYNAHNVYIMTDKAKNGIKVNFKIRHNIEDGSVQLA<br>DHYQQNTPIGDGPVLLPDNHYLSTQSALSKDPNEKRDHMIYF<br>GFVTAAAITHGMDELYK* | | |
| OT-hPDE5N-<br>053 (OT-<br>001249, OT-<br>hPDE5 -053)<br>hPDE5<br>(Amino acid<br>590-836 of<br>WT, R732C);<br>linker (SG);<br>AcGFP<br>(Amino acid 2-<br>239 of WT);<br>stop | MKHEVLCRWILSVKKNYRKNVAYHNWRHAFNTAQCMFAAL<br>KAGKIQNKLTDLEILALLIAALSHDLDHRGVNNSYIQRSEHPL<br>AQLYCHSIMEHHHFDQCLMILNSPGNQILSGLSIEEYKTTLKIIK<br>QAILATDLALYIKRCGEFFELIRKNQFNLEDPHQKELFLAMLM<br>TACDLSAITKPWPIQQRIAELVATEFFDQGDRERKELNIEPTDL<br>MNREKKNKIPSMQVGFIDAICLQLYEALTHVSSGVSKGAELFT<br>GIVPILIELNGDVNGHKFSVSGEGEGDATYGKLTLKFICTTGKL<br>PVPWPTLVTTLSYGVQCFSRYPDHMKQHDFFKSAMPEGYIQE<br>RTIFFEDDGNYKSRAEVKFEGDTLVNRIELTGTDFKEDGNILG<br>NKMEYNYNAHNVYIMTDKAKNGIKVNFKIRHNIEDGSVQLA<br>DHYQQNTPIGDGPVLLPDNHYLSTQSALSKDPNEKRDHMIYF<br>GFVTAAAITHGMDELYK* | 203 | 221 |
| OT-hPDE5N-<br>054 (OT-<br>001250, OT-<br>hPDE5-054)<br>hPDE5<br>(Amino acid<br>590-836 of<br>WT, R732K);<br>linker (SG);<br>AcGFP<br>(Amino acid 2-<br>239 of WT);<br>stop | MKHEVLCRWILSVKKNYRKNVAYHNWRHAFNTAQCMFAAL<br>KAGKIQNKLTDLEILALLIAALSHDLDHRGVNNSYIQRSEHPL<br>AQLYCHSIMEHHHFDQCLMILNSPGNQILSGLSIEEYKTTLKIIK<br>QAILATDLALYIKRKGEFFELIRKNQFNLEDPHQKELFLAMLM<br>TACDLSAITKPWPIQQRIAELVATEFFDQGDRERKELNIEPTDL<br>MNREKKNKIPSMQVGFIDAICLQLYEALTHVSSGVSKGAELFT<br>GIVPILIELNGDVNGHKFSVSGEGEGDATYGKLTLKFICTTGKL<br>PVPWPTLVTTLSYGVQCFSRYPDHMKQHDFFKSAMPEGYIQE<br>RTIFFEDDGNYKSRAEVKFEGDTLVNRIELTGTDFKEDGNILG<br>NKMEYNYNAHNVYIMTDKAKNGIKVNFKIRHNIEDGSVQLA<br>DHYQQNTPIGDGPVLLPDNHYLSTQSALSKDPNEKRDHMIYF<br>GFVTAAAITHGMDELYK* | 204 | 222 |
| OT-hPDE5-<br>064 (OT-<br>001186)<br>Methionine;<br>hPDE5<br>(Amino acid<br>535-860 of<br>WT, R732G);<br>linker (SG);<br>AcGFP<br>(Amino acid 2-<br>239 of WT);<br>stop | MEETRELQSLAAAVVPSAQTLKITDFSFSDFELSDLETALCTIR<br>MFTDLNLVQNFQMKHEVLCRWILSVKKNYRKNVAYHNWRH<br>AFNTAQCMFAALKAGKIQNKLTDLEILALLTAALSHDLDHRG<br>VNNSYIQRSEHPLAQLYCHSIMEHHHFDQCLMILNSPGNQILS<br>GLSIEEYKTTLKIIKQAILATDLALYIKRGGEFFELIRKNQFNLE<br>DPHQKELFLAMLMTACDLSAITKPWPIQQRIAELVATEFFDQG<br>DRERKELNIEPTDLMNREKKNKIPSMQVGFIDAICLQLYEALT<br>HVSEDCFPLLDGCRKNRQKWQALAEQQSGVSKGAELFTGIVP<br>ILIELNGDVNGHKFSVSGEGEGDATYGKLTLKFICTTGKLPVP<br>WPTLVTTLSYGVQCFSRYPDHMKQHDFFKSAMPEGYIQERTIF<br>FEDDGNYKSRAEVKFEGDTLVNRIELTGTDFKEDGNILGNKM<br>EYNYNAHNVYIMTDKAKNGIKVNFKIRHNIEDGSVQLADHYQ<br>QNTPIGDGPVLLPDNHYLSTQSALSKDPNEKRDHMIYFGFVTA<br>AAITHGMDELYK* | 430 | 467 |
| OT-hPDE5-<br>065 (OT-<br>001187)<br>Methionine;<br>hPDE5<br>(Amino acid<br>535-860 of<br>WT, R732 A);<br>linker (SG);<br>AcGFP<br>(Amino acid 2-<br>239 of WT);<br>stop | MEETRELQSLAAAVVPSAQTLKITDFSFSDFELSDLETALCTIR<br>MFTDLNLVQNFQMKHEVLCRWILSVKKNYRKNVAYHNWRH<br>AFNTAQCMFAALKAGKIQNKLTDLEILALLTAALSHDLDHRG<br>VNNSYIQRSEHPLAQLYCHSIMEHHHFDQCLMILNSPGNQILS<br>GLSIEEYKTTLKIIKQAILATDLALYIKRAGEFFELIRKNQFNLE<br>DPHQKELFLAMLMTACDLSAITKPWPIQQRIAELVATEFFDQG<br>DRERKELNIEPTDLMNREKKNKIPSMQVGFIDAICLQLYEALT<br>HVSEDCFPLLDGCRKNRQKWQALAEQQSGVSKGAELFTGIVP<br>ILIELNGDVNGHKFSVSGEGEGDATYGKLTLKFICTTGKLPVP<br>WPTLVTTLSYGVQCFSRYPDHMKQHDFFKSAMPEGYIQERTIF<br>FEDDGNYKSRAEVKFEGDTLVNRIELTGTDFKEDGNILGNKM<br>EYNYNAHNVYIMTDKAKNGIKVNFKIRHNIEDGSVQLADHYQ<br>QNTPIGDGPVLLPDNHYLSTQSALSKDPNEKRDHMIYFGFVTA<br>AAITHGMDELYK* | 431 | 468 |
| OT-hPDE5-<br>066 (OT-<br>001188)<br>Methionine;<br>hPDE5<br>(Amino acid<br>535-860 of<br>WT, R732V);<br>linker (SG);<br>AcGFP | MEETRELQSLAAAVVPSAQTLKITDFSFSDFELSDLETALCTIR<br>MFTDLNLVQNFQMKHEVLCRWILSVKKNYRKNVAYHNWRH<br>AFNTAQCMFAALKAGKIQNKLTDLEILALLTAALSHDLDHRG<br>VNNSYIQRSEHPLAQLYCHSIMEHHHFDQCLMILNSPGNQILS<br>GLSIEEYKTTLKIIKQAILATDLALYIKRVGEFFELIRKNQFNLE<br>DPHQKELFLAMLMTACDLSAITKPWPIQQRIAELVATEFFDQG<br>DRERKELNIEPTDLMNREKKNKIPSMQVGFIDAICLQLYEALT<br>HVSEDCFPLLDGCRKNRQKWQALAEQQSGVSKGAELFTGIVP<br>ILIELNGDVNGHKFSVSGEGEGDATYGKLTLKFICTTGKLPVP<br>WPTLVTTLSYGVQCFSRYPDHMKQHDFFKSAMPEGYIQERTIF | 432 | 469 |

TABLE 6-continued hPDE5_R732 constructs

| Construct ID/ Description | Sequence | AA SEQ ID NO. | NA SEQ ID NO. |
|---|---|---|---|
| (Amino acid 2-239 of WT); stop | FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | | |
| OT-hPDE5-067 (OT-001189) Methionine; hPDE5 (Amino acid 535-860 of WT, R732I); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLTAALSHDLDHRG VNNSYIQRSEHPLAQLYCHSIMEHHHFDQCLMILNSPGNQILS GLSIEEYKTTLKIIKQAILATDLALYIKRIGEFFELIRKNQFNLED PHQKELFLAMLMTACDLSAITKPWPIQQRIAELVATEFFDQGD RERKELNIEPTDLMNREKKNKIPSMQVGFIDAICLQLYEALTH VSEDCFPLLDGCRKNRQKWQALAEQQSGVSKGAELFTGIVPIL IELNGDVNGHKFSVSGEGEGDATYGKLTLKFICTTGKLPVPWP TLVTTLSYGVQCFSRYPDHMKQHDFFKSAMPEGYIQERTIFFE DDGNYKSRAEVKFEGDTLVNRIELTGTDFKEDGNILGNKMEY NYNAHNVYIMTDKAKNGIKVNFKIRHNIEDGSVQLADHYQQ NTPIGDGPVLLPDNHYLSTQSALSKDPNEKRDHMIYFGFVTAA AITHGMDELYK* | 433 | 470 |
| OT-hPDE5-068 (OT-001190) Methionine; hPDE5 (Amino acid 535-860 of WT, R732P); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLTAALSHDLDHRG VNNSYIQRSEHPLAQLYCHSIMEHHHFDQCLMILNSPGNQILS GLSIEEYKTTLKIIKQAILATDLALYIKRPGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | 434 | 471 |
| OT-hPDE5-069 (OT-001191) Methionine; hPDE5 (Amino acid 535-860 of WT, R732F); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLTAALSHDLDHRG VNNSYIQRSEHPLAQLYCHSIMEHHHFDQCLMILNSPGNQILS GLSIEEYKTTLKIIKQAILATDLALYIKRFGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | 435 | 472 |
| OT-hPDE5-070 (OT-001192) Methionine; hPDE5 (Amino acid 535-860 of WT, R732W); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKRWGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | 436 | 473 |
| OT-hPDE5-071 (OT-001193) Methionine; hPDE5 (Amino acid 535-860 of WT, R732Y); linker (SG); | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKRYGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP | 437 | 474 |

TABLE 6-continued hPDE5 R732 constructs

| Construct ID/ Description | Sequence | AA SEQ ID NO. | NA SEQ ID NO. |
|---|---|---|---|
| AcGFP (Amino acid 2-239 of WT); stop | WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | | |
| OT-hPDE5-072 (OT-001195) Methionine; hPDE5 (Amino acid 535-860 of WT, R732H); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKRHGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | 438 | 475 |
| OT-hPDE5-073 (OT-001196) Methionine; hPDE5 (Amino acid 535-860 of WT, R732S); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKRSGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | 439 | 476 |
| OT-hPDE5-074 (OT-001197) Methionine; hPDE5 (Amino acid 535-860 of WT, R732T); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKRTGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | 440 | 477 |
| OT-hPDE5-075 (OT-001198) Methionine; hPDE5 (Amino acid 535-860 of WT, R732D); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKRDGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | 441 | 478 |
| OT-hPDE5-076 (OT-001199) Methionine; hPDE5 (Amino acid 535-860 of WT, R732E); | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKREGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP | 442 | 479 |

TABLE 6-continued hPDE5 R732 constructs

| Construct ID/ Description | Sequence | AA SEQ ID NO. | NA SEQ ID NO. |
|---|---|---|---|
| linker (SG); AcGFP (Amino acid 2-239 of WT); stop | ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | | |
| OT-hPDE5-077 (OT-001200) Methionine; hPDE5 (Amino acid 535-860 of WT, R732Q); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKRQGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | 443 | 480 |
| OT-hPDE5-078 (OT-001201) Methionine; hPDE5 (Amino acid 535-860 of WT, R732N); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKRNGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | 444 | 481 |
| OT-hPDE5-079 (OT-001202) Methionine; hPDE5 (Amino acid 535-860 of WT, R732M); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKRMGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | 445 | 482 |
| OT-hPDE5-080 (OT-001203) Methionine; hPDE5 (Amino acid 535-860 of WT, R732C); linker (SG); AcGFP (Amino acid 2-239 of WT); stop | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKRCGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | 446 | 483 |
| OT-hPDE5-081 (OT-001204) Methionine; hPDE5 (Amino acid 535-860 of | MEETRELQSLAAAVVPSAQTLKITDFSFSDFELSDLETALCTIR MFTDLNLVQNFQMKHEVLCRWILSVKKNYRKNVAYHNWRH AFNTAQCMFAALKAGKIQNKLTDLEILALLIAALSHDLDHRG VNNSYIQRSEHPLAQLYCHSIMEHHHFDQCLMILNSPGNQILS GLSIEEYKTTLKIIKQAILATDLALYIKRKGEFFELIRKNQFNLE DPHQKELFLAMLMTACDLSAITKPWPIQQRIAELVATEFFDQG DRERKELNIEPTDLMNREKKNKIPSMQVGFIDAICLQLYEALT | 447 | 484 |

TABLE 6-continued hPDE5 R732 constructs

| Construct ID/ Description | Sequence | AA SEQ ID NO. | NA SEQ ID NO. |
|---|---|---|---|
| WT, R732K); linker (SG); AcGFP (Amino acid 2-239 of WT); stop | HVSEDCFPLLDGCRKNRQKWQALAEQQSGVSKGAELFTGIVP ILIELNGDVNGHKFSVSGEGEGDATYGKLTLKFICTTGKLPVP WPTLVTTLSYGVQCFSRYPDHMKQHDFFFKSAMPEGYIQERTIF FEDDGNYKSRAEVKFEGDTLVNRIELTGTDFKEDGNILGNKM EYNYNAHNVYIMTDKAKNGIKVNFKIRHNIEDGSVQLADHYQ QNTPIGDGPVLLPDNHYLSTQSALSKDPNEKRDHMIYFGFVTA AAITHGMDELYK* | | |
| OT-hPDE5-096 (OT-001279) AcGFP (Amino acid 1-239 of WT); linker (GS); hPDE5 (Amino acid 535-860 of WT, R732G); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRGGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | 448 | 485 |
| OT-hPDE5-097 (OT-001280) AcGFP (Amino acid 1-239 of WT); linker (GS); hPDE5 (Amino acid 535-860 of WT, R732A); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRAGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | 449 | 486 |
| OT-hPDE5-098 (OT-001281) AcGFP (Amino acid 1-239 of WT); linker (GS); hPDE5 (Amino acid 535-860 of WT, R732L); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRLGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | 450 | 487 |
| OT-hPDE5-099 (OT-001282) AcGFP (Amino acid 1-239 of WT); linker (GS); hPDE5 (Amino acid 535-860 of WT, R732M); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRMGEFFELIRKNQFNLEDPHQKELFLAMLMTAC DLSAITKPWPIQQRIAELVATEFFDQGDRERKELNIEPTDLMNR EKKNKIPSMQVGFIDAICLQLYEALTHVSEDCFPLLDGCRKNR QKWQALAEQQSR* | 451 | 488 |
| OT-hPDE5-100 (OT-001283) AcGFP (Amino acid 1-239 of WT); | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV | 452 | 489 |

TABLE 6-continued hPDE5 R732 constructs

| Construct ID/ Description | Sequence | AA SEQ ID NO. | NA SEQ ID NO. |
|---|---|---|---|
| linker (GS); hPDE5 (Amino acid 535-860 of WT, R732F); Xba I site (TCTAGA); stop | PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRFGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | | |
| OT-hPDE5-101 (OT-001284) AcGFP (Amino acid 1-239 of WT); linker (GS); hPDE5 (Amino acid 535-860 of WT, R732W); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRWGEFFELIRKNQFNLEDPHQKELFLAMLMTAC DLSAITKPWPIQQRIAELVATEFFDQGDRERKELNIEPTDLMNR EKKNKIPSMQVGFIDAICLQLYEALTHVSEDCFPLLDGCRKNR QKWQALAEQQSR* | 453 | 490 |
| OT-hPDE5-102 (OT-001285) AcGFP (Amino acid 1-239 of WT); linker (GS); hPDE5 (Amino acid 535-860 of WT, R732K); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRKGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | 454 | 491 |
| OT-hPDE5-103 (OT-001286) AcGFP (Amino acid 1-239 of WT); linker (GS); hPDE5 (Amino acid 535-860 of WT, R732Q); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRQGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | 455 | 492 |
| OT-hPDE5-104 (OT-001287) AcGFP (Amino acid 1-239 of WT); linker (GS); hPDE5 (Amino acid 535-860 of WT, R732E); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKREGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | 456 | 493 |
| OT-hPDE5-105 (OT-001288) AcGFP (Amino acid 1- | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN | 457 | 494 |

TABLE 6-continued hPDE5 R732 constructs

| Construct ID/ Description | Sequence | AA SEQ ID NO. | NA SEQ ID NO. |
|---|---|---|---|
| 239 of WT); linker (GS); hPDE5 (Amino acid 535-860 of WT, R732S); Xba I site (TCTAGA); stop | EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRSGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | | |
| OT-hPDE5-106 (OT-001289) AcGFP (Amino acid 1-239 of WT); linker (GS); hPDE5 (Amino acid 535-860 of WT, R732P); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRPGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | 458 | 495 |
| OT-hPDE5-107 (OT-001290) AcGFP (Amino acid 1-239 of WT); linker (GS); hPDE5 (Amino acid 535-860 of WT, R732V); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRVGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | 459 | 496 |
| OT-hPDE5-108 (OT-001291) AcGFP (Amino acid 1-239 of WT); linker (GS); hPDE5 (Amino acid 535-860 of WT, R732I); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRIGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | 460 | 497 |
| OT-hPDE5-109 (OT-001292) AcGFP (Amino acid 1-239 of WT); linker (GS); hPDE5 (Amino acid 535-860 of WT, R732C); Xba I site (TCTAGA); stop | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH NIEDGSVQLADHYQQNTPIGDGPVLLPDNHYLSTQSALSKDPN EKRDHMIYFGFVTAAAITHGMDELYKGSEETRELQSLAAAVV PSAQTLKITDFSFSDFELSDLETALCTIRMFTDLNLVQNFQMKH EVLCRWILSVKKNYRKNVAYHNWRHAFNTAQCMFAALKAG KIQNKLTDLEILALLIAALSHDLDHRGVNNSYIQRSEHPLAQLY CHSIMEHHHFDQCLMILNSPGNQILSGLSIEEYKTTLKIIKQAIL ATDLALYIKRCGEFFELIRKNQFNLEDPHQKELFLAMLMTACD LSAITKPWPIQQRIAELVATEFFDQGDRERKELNIEPTDLMNRE KKNKIPSMQVGFIDAICLQLYEALTHVSEDCFPLLDGCRKNRQ KWQALAEQQSR* | 461 | 498 |
| OT-hPDE5-110 (OT-001293) AcGFP | MVSKGAELFTGIVPILIELNGDVNGHKFSVSGEGEGDATYGKL TLKFICTTGKLPVPWPTLVTTLSYGVQCFSRYPDHMKQHDFFK SAMPEGYIQERTIFFEDDGNYKSRAEVKFEGDTLVNRIELTGT DFKEDGNILGNKMEYNYNAHNVYIMTDKAKNGIKVNFKIRH | 462 | 499 |

TABLE 6-continued hPDE5 R732 constructs

| Construct ID/<br>Description | Sequence | AA<br>SEQ ID<br>NO. | NA<br>SEQ ID<br>NO. |
|---|---|---|---|
| (Amino acid 1-<br>239 of WT);<br>linker (GS);<br>hPDE5<br>(Amino acid<br>535-860 of<br>WT, R732Y);<br>Xba I site<br>(TCTAGA);<br>stop | NIEDGSVQLADHYQQNTPIGDGPVLLPDNHYLSTQSALSKDPN<br>EKRDHMIYFGFVTAAAITHGMDELYKGSEETRELQSLAAAVV<br>PSAQTLKITDFSFSDFELSDLETALCTIRMFTDLNLVQNFQMKH<br>EVLCRWILSVKKNYRKNVAYHNWRHAFNTAQCMFAALKAG<br>KIQNKLTDLEILALLIAALSHDLDHRGVNNSYIQRSEHPLAQLY<br>CHSIMEHHHFDQCLMILNSPGNQILSGLSIEEYKTTLKIIKQAIL<br>ATDLALYIKRYGEFFELIRKNQFNLEDPHQKELFLAMLMTACD<br>LSAITKPWPIQQRIAELVATEFFDQGDRERKELNIEPTDLMNRE<br>KKNKIPSMQVGFIDAICLQLYEALTHVSEDCFPLLDGCRKNRQ<br>KWQALAEQQSR* | | |
| OT-hPDE5-<br>111 (OT-<br>001294)<br>AcGFP<br>(Amino acid 1-<br>239 of WT);<br>linker (GS);<br>hPDE5<br>(Amino acid<br>535-860 of<br>WT, R732H);<br>Xba I site<br>(TCTAGA);<br>stop | MVSKGAELFTGIVPILIELNGDVNGHKFSVSGEGEGDATYGKL<br>TLKFICTTGKLPVPWPTLVTTLSYGVQCFSRYPDHMKQHDFFK<br>SAMPEGYIQERTIFFEDDGNYKSRAEVKFEGDTLVNRIELTGT<br>DFKEDGNILGNKMEYNYNAHNVYIMTDKAKNGIKVNFKIRH<br>NIEDGSVQLADHYQQNTPIGDGPVLLPDNHYLSTQSALSKDPN<br>EKRDHMIYFGFVTAAAITHGMDELYKGSEETRELQSLAAAVV<br>PSAQTLKITDFSFSDFELSDLETALCTIRMFTDLNLVQNFQMKH<br>EVLCRWILSVKKNYRKNVAYHNWRHAFNTAQCMFAALKAG<br>KIQNKLTDLEILALLIAALSHDLDHRGVNNSYIQRSEHPLAQLY<br>CHSIMEHHHFDQCLMILNSPGNQILSGLSIEEYKTTLKIIKQAIL<br>ATDLALYIKRHGEFFELIRKNQFNLEDPHQKELFLAMLMTACD<br>LSAITKPWPIQQRIAELVATEFFDQGDRERKELNIEPTDLMNRE<br>KKNKIPSMQVGFIDAICLQLYEALTHVSEDCFPLLDGCRKNRQ<br>KWQALAEQQSR* | 463 | 500 |
| OT-hPDE5-<br>112 (OT-<br>001295)<br>AcGFP<br>(Amino acid 1-<br>239 of WT);<br>linker (GS);<br>hPDE5<br>(Amino acid<br>535-860 of<br>WT, R732N);<br>Xba I site<br>(TCTAGA);<br>stop | MVSKGAELFTGIVPILIELNGDVNGHKFSVSGEGEGDATYGKL<br>TLKFICTTGKLPVPWPTLVTTLSYGVQCFSRYPDHMKQHDFFK<br>SAMPEGYIQERTIFFEDDGNYKSRAEVKFEGDTLVNRIELTGT<br>DFKEDGNILGNKMEYNYNAHNVYIMTDKAKNGIKVNFKIRH<br>NIEDGSVQLADHYQQNTPIGDGPVLLPDNHYLSTQSALSKDPN<br>EKRDHMIYFGFVTAAAITHGMDELYKGSEETRELQSLAAAVV<br>PSAQTLKITDFSFSDFELSDLETALCTIRMFTDLNLVQNFQMKH<br>EVLCRWILSVKKNYRKNVAYHNWRHAFNTAQCMFAALKAG<br>KIQNKLTDLEILALLIAALSHDLDHRGVNNSYIQRSEHPLAQLY<br>CHSIMEHHHFDQCLMILNSPGNQILSGLSIEEYKTTLKIIKQAIL<br>ATDLALYIKRNGEFFELIRKNQFNLEDPHQKELFLAMLMTACD<br>LSAITKPWPIQQRIAELVATEFFDQGDRERKELNIEPTDLMNRE<br>KKNKIPSMQVGFIDAICLQLYEALTHVSEDCFPLLDGCRKNRQ<br>KWQALAEQQSR* | 464 | 501 |
| OT-hPDE5-<br>113 (OT-<br>001296)<br>AcGFP<br>(Amino acid 1-<br>239 of WT);<br>linker (GS);<br>hPDE5<br>(Amino acid<br>535-860 of<br>WT, R732D);<br>Xba I site<br>(TCTAGA);<br>stop | MVSKGAELFTGIVPILIELNGDVNGHKFSVSGEGEGDATYGKL<br>TLKFICTTGKLPVPWPTLVTTLSYGVQCFSRYPDHMKQHDFFK<br>SAMPEGYIQERTIFFEDDGNYKSRAEVKFEGDTLVNRIELTGT<br>DFKEDGNILGNKMEYNYNAHNVYIMTDKAKNGIKVNFKIRH<br>NIEDGSVQLADHYQQNTPIGDGPVLLPDNHYLSTQSALSKDPN<br>EKRDHMIYFGFVTAAAITHGMDELYKGSEETRELQSLAAAVV<br>PSAQTLKITDFSFSDFELSDLETALCTIRMFTDLNLVQNFQMKH<br>EVLCRWILSVKKNYRKNVAYHNWRHAFNTAQCMFAALKAG<br>KIQNKLTDLEILALLIAALSHDLDHRGVNNSYIQRSEHPLAQLY<br>CHSIMEHHHFDQCLMILNSPGNQILSGLSIEEYKTTLKIIKQAIL<br>ATDLALYIKRDGEFFELIRKNQFNLEDPHQKELFLAMLMTACD<br>LSAITKPWPIQQRIAELVATEFFDQGDRERKELNIEPTDLMNRE<br>KKNKIPSMQVGFIDAICLQLYEALTHVSEDCFPLLDGCRKNRQ<br>KWQALAEQQSR* | 465 | 502 |
| OT-hPDE5-<br>114 (OT-<br>001297)<br>AcGFP<br>(Amino acid 1-<br>239 of WT);<br>linker (GS);<br>hPDE5<br>(Amino acid<br>535-860 of<br>WT, R732T);<br>Xba I site<br>(TCTAGA);<br>stop | MVSKGAELFTGIVPILIELNGDVNGHKFSVSGEGEGDATYGKL<br>TLKFICTTGKLPVPWPTLVTTLSYGVQCFSRYPDHMKQHDFFK<br>SAMPEGYIQERTIFFEDDGNYKSRAEVKFEGDTLVNRIELTGT<br>DFKEDGNILGNKMEYNYNAHNVYIMTDKAKNGIKVNFKIRH<br>NIEDGSVQLADHYQQNTPIGDGPVLLPDNHYLSTQSALSKDPN<br>EKRDHMIYFGFVTAAAITHGMDELYKGSEETRELQSLAAAVV<br>PSAQTLKITDFSFSDFELSDLETALCTIRMFTDLNLVQNFQMKH<br>EVLCRWILSVKKNYRKNVAYHNWRHAFNTAQCMFAALKAG<br>KIQNKLTDLEILALLIAALSHDLDHRGVNNSYIQRSEHPLAQLY<br>CHSIMEHHHFDQCLMILNSPGNQILSGLSIEEYKTTLKIIKQAIL<br>ATDLALYIKRTGEFFELIRKNQFNLEDPHQKELFLAMLMTACD<br>LSAITKPWPIQQRIAELVATEFFDQGDRERKELNIEPTDLMNRE<br>KKNKIPSMQVGFIDAICLQLYEALTHVSEDCFPLLDGCRKNRQ<br>KWQALAEQQSR* | 466 | 503 |

In some embodiments, any of the mutations taught in Tables 1, 2, and 5A may be combined. In one embodiment, the combination mutations are provided in Table 7. Combination mutations may be linked to AcGFP (Amino acid 2-239 of WT) (SEQ ID NO. 79); encoded by the nucleotide sequence of SEQ ID NO. 372; AcGFP (Amino acid 1-239 of WT) (SEQ ID NO. 365); encoded by the nucleotide sequence of SEQ ID NO. 94; or firefly luciferase, Fluc (N50D, N119G, S548I, K549A, L550V) (SEQ ID NO. 223) encoded by the nucleotide sequence of SEQ ID NO. 224. In some embodiments, the portions of the construct may be linked through a linker e.g. SG linker, encoded by the nucleotide sequence (AGTGGT). In some embodiments, the constructs described in Table 7 may comprise an Xba I restriction site, SR, encoded by the nucleotide sequence, TCTAGA. Table 7 provides the constructs comprising the combination mutations. In Table 7, translation of the stop codon is indicated by asterisk. Also provided in Table 7 are alternate aliases for a given construct ID. These aliases are identified by the prefix OT.

TABLE 7 hPDE5 combination mutations

| Construct ID/ Description | Sequence | AA SEQ ID NO. | NA SEQ ID NO. |
|---|---|---|---|
| hPDE5 (Amino acid 535-860 of WT, F736A, D764N) | EETRELQSLAAAVVPSAQTLKITDFSFSDFELSDLETALCT IRMFTDLNLVQNFQMKHEVLCRWILSVKKNYRKNVAYH NWRHAFNTAQCMFAALKAGKIQNKLTDLEILALLIAALS HDLDHRGVNNSYIQRSEHPLAQLYCHSIMEHHHFDQCLM ILNSPGNQILSGLSIEEYKTTLKIIKQAILATDLALYIKRRG EFAELIRKNQFNLEDPHQKELFLAMLMTACNLSAITKPW PIQQRIAELVATEFFDQGDRERKELNIEPTDLMNREKKNK IPSMQVGFIDAICLQLYEALTHVSEDCFPLLDGCRKNRQK WQALAEQQ | 504 | 519 |
| Methionine; hPDE5 (Amino acid 535-860 of WT, F736A, D764N) | MEETRELQSLAAAVVPSAQTLKITDFSFSDFELSDLETAL CTIRMFTDLNLVQNFQMKHEVLCRWILSVKKNYRKNVA YHNWRHAFNTAQCMFAALKAGKIQNKLTDLEILALLIAA LSHDLDHRGVNNSYIQRSEHPLAQLYCHSIMEHHHFDQC LMILNSPGNQILSGLSIEEYKTTLKIIKQAILATDLALYIKR RGEFAELIRKNQFNLEDPHQKELFLAMLMTACNLSAITKP WPIQQRIAELVATEFFDQGDRERKELNIEPTDLMNREKKN KIPSMQVGFIDAICLQLYEALTHVSEDCFPLLDGCRKNRQ KWQALAEQQ | 225 | 231 |
| hPDE5 (Amino acid 535-860 of WT, R732L, D764N) | EETRELQSLAAAVVPSAQTLKITDFSFSDFELSDLETALCT IRMFTDLNLVQNFQMKHEVLCRWILSVKKNYRKNVAYH NWRHAFNTAQCMFAALKAGKIQNKLTDLEILALLIAALS HDLDHRGVNNSYIQRSEHPLAQLYCHSIMEHHHFDQCLM ILNSPGNQILSGLSIEEYKTTLKIIKQAILATDLALYIKRLG EFFELIRKNQFNLEDPHQKELFLAMLMTACNLSAITKPWP IQQRIAELVATEFFDQGDRERKELNIEPTDLMNREKKNKI PSMQVGFIDAICLQLYEALTHVSEDCFPLLDGCRKNRQK WQALAEQQ | 505 | 520 |
| Methionine; hPDE5 (Amino acid 535-860 of WT, R732L, D764N) | MEETRELQSLAAAVVPSAQTLKITDFSFSDFELSDLETAL CTIRMFTDLNLVQNFQMKHEVLCRWILSVKKNYRKNVA YHNWRHAFNTAQCMFAALKAGKIQNKLTDLEILALLIAA LSHDLDHRGVNNSYIQRSEHPLAQLYCHSIMEHHHFDQC LMILNSPGNQILSGLSIEEYKTTLKIIKQAILATDLALYIKR LGEFFELIRKNQFNLEDPHQKELFLAMLMTACNLSAITKP WPIQQRIAELVATEFFDQGDRERKELNIEPTDLMNREKKN KIPSMQVGFIDAICLQLYEALTHVSEDCFPLLDGCRKNRQ KWQALAEQQ | 226 | 232 |
| hPDE5 (Amino acid 535-860 of WT, R732L, F736A) | EETRELQSLAAAVVPSAQTLKITDFSFSDFELSDLETALCTI RMFTDLNLVQNFQMKHEVLCRWILSVKKNYRKNVAYHN WRHAFNTAQCMFAALKAGKIQNKLTDLEILALLIAALSH DLDHRGVNNSYIQRSEHPLAQLYCHSIMEHHHFDQCMIL NSPGNQILSGLSIEEYKTTLKIIKQAILATDLALYIKRLGEF AELIRKNQFNLEDPHQKELFLAMLMTACDLSAITKPWPIQ QRIAELVATEFFDQGDRERKELNIEPTDLMNREKKNKIPS MQVGFIDAICLQLYEALTHVSEDCFPLLDGCRKNRQKWQ ALAEQQ | 227 | 233 |
| hPDE5 (Amino acid 535-860 of WT, Y612F, R732L) | EETRELQSLAAAVVPSAQTLKITDFSFSDFELSDLETALCTI RMFTDLNLVQNFQMKHEVLCRWILSVKKNYRKNVAFHN WRHAFNTAQCMFAALKAGKIQNKLTDLEILALLIAALSH DLDHRGVNNSYIQRSEHPLAQLYCHSIMEHHHFDQCMIL NSPGNQILSGLSIEEYKTTLKIIKQAILATDLALYIKRLGEFF ELIRKNQFNLEDPHQKELFLAMLMTACDLSAITKPWPIQQ RIAELVATEFFDQGDRERKELNIEPTDLMNREKKNKIPSM QVGFIDAICLQLYEALTHVSEDCFPLLDGCRKNRQKWQA LAEQQ | 506 | 521 |

TABLE 7-continued hPDE5 combination mutations

| Construct ID/ Description | Sequence | AA SEQ ID NO. | NA SEQ ID NO. |
|---|---|---|---|
| hPDE5 (Amino acid 535-860 of WT, Y612W, R732L) | EETRELQSLAAAVVPSAQTLKITDFSFSDFELSDLETALCTI RMFTDLNLVQNFQMKHEVLCRWILSVKKNYRKNVAWH NWRHAFNTAQCMFAALKAGKIQNKLTDLEILALLIAALS HDLDHRGVNNSYIQRSEHPLAQLYCHSIMEHHHFDQCLMI LNSPGNQILSGLSIEEYKTTLKIIKQAILATDLALYIKRLGEF FELIRKNQFNLEDPHQKELFLAMLMTACDLSAITKPWPIQ QRIAELVATEFFDQGDRERKELNIEPTDLMNREKKNKIPS MQVGFIDAICLQLYEALTHVSEDCFPLLDGCRKNRQKWQ ALAEQQ | 507 | 522 |
| hPDE5 (Amino acid 535-860 of WT, Y612A, R732L) | EETRELQSLAAAVVPSAQTLKITDFSFSDFELSDLETALCTI RMFTDLNLVQNFQMKHEVLCRWILSVKKNYRKNVAAHN WRHAFNTAQCMFAALKAGKIQNKLTDLEILALLIAALSH DLDHRGVNNSYIQRSEHPLAQLYCHSIMEHHHFDQCLMIL NSPGNQILSGLSIEEYKTTLKIIKQAILATDLALYIKRLGEFF ELIRKNQFNLEDPHQKELFLAMLMTACDLSAITKPWPIQQ RIAELVATEFFDQGDRERKELNIEPTDLMNREKKNKIPSM QVGFIDAICLQLYEALTHVSEDCFPLLDGCRKNRQKWQA LAEQQ | 508 | 523 |
| hPDE5 (Amino acid 535-860 of WT, H653A, R732L) | EETRELQSLAAAVVPSAQTLKITDFSFSDFELSDLETALCTI RMFTDLNLVQNFQMKHEVLCRWILSVKKNYRKNVAYHN WRHAFNTAQCMFAALKAGKIQNKLTDLEILALLTAALSA DLDHRGVNNSYIQRSEHPLAQLYCHSIMEHHHFDQCLMIL NSPGNQILSGLSIEEYKTTLKIIKQAILATDLALYIKRLGEFF ELIRKNQFNLEDPHQKELFLAMLMTACDLSAITKPWPIQQ RIAELVATEFFDQGDRERKELNIEPTDLMNREKKNKIPSM QVGFIDAICLQLYEALTHVSEDCFPLLDGCRKNRQKWQA LAEQQ | 509 | 524 |
| hPDE5 (Amino acid 535-860 of WT, R732L, D764A) | EETRELQSLAAAVVPSAQTLKITDFSFSDFELSDLETALCTI RMFTDLNLVQNFQMKHEVLCRWILSVKKNYRKNVAYHN WRHAFNTAQCMFAALKAGKIQNKLTDLEILALLTAALSH DLDHRGVNNSYIQRSEHPLAQLYCHSIMEHHHFDQCLMIL NSPGNQILSGLSIEEYKTTLKIIKQAILATDLALYIKRLGEFF ELIRKNQFNLEDPHQKELFLAMLMTACALSAITKPWPIQQ RIAELVATEFFDQGDRERKELNIEPTDLMNREKKNKIPSM QVGFIDAICLQLYEALTHVSEDCFPLLDGCRKNRQKWQA LAEQQ | 510 | 525 |
| OT-hPDE5N-025 (OT-001222, OT-hPDE5-025) Methionine; hPDE5 (Amino acid 535-860 of WT, F736A, D764N); linker (SG); AcGFP (Amino acid 2-239 of WT); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRR GEFAELIRKNQFNLEDPHQKELFLAMLMTACNLSAITKPW PIQQRIAELVATEFFDQGDRERKELNIEPTDLMNREKKNKI PSMQVGFIDAICLQLYEALTHVSEDCFPLLDGCRKNRQKW QALAEQQSGVSKGAELFTGIVPILIELNGDVNGHKFSVSGE GEGDATYGKLTLKFICTTGKLPVPWPTLVTTLSYGVQCFS RYPDHMKQHDFFKSAMPEGYIQERTIFFEDDGNYKSRAE VKFEGDTLVNRIELTGTDFKEDGNILGNKMEYNYNAHNV YIMTDKAKNGIKVNFKIRHNIEDGSVQLADHYQQNTPIGD GPVLLPDNHYLSTQSALSKDPNEKRDHMIYFGFVTAAAIT HGMDELYK* | 228 | 234 |
| OT-hPDE5N-026 (OT-001223, OT-hPDE5-026) Methionine; hPDE5 (Amino acid 535-860 of WT, R732L, D764N); linker (SG); AcGFP (Amino acid 2-239 of WT); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRLG EFFELIRKNQFNLEDPHQKELFLAMLMTACNLSAITKPWPI QQRIAELVATEFFDQGDRERKELNIEPTDLMNREKKNKIPS MQVGFIDAICLQLYEALTHVSEDCFPLLDGCRKNRQKWQ ALAEQQSGVSKGAELFTGIVPILIELNGDVNGHKFSVSGEG EGDATYGKLTLKFICTTGKLPVPWPTLVTTLSYGVQCFSR YPDHMKQHDFFKSAMPEGYIQERTIFFEDDGNYKSRAEV KFEGDTLVNRIELTGTDFKEDGNILGNKMEYNYNAHNVY IMTDKAKNGIKVNFKIRHNIEDGSVQLADHYQQNTPIGDG PVLLPDNHYLSTQSALSKDPNEKRDHMIYFGFVTAAAITH GMDELYK* | 229 | 235 |

TABLE 7-continued hPDE5 combination mutations

| Construct ID/ Description | Sequence | AA SEQ ID NO. | NA SEQ ID NO. |
|---|---|---|---|
| OT-hPDE5C-035 (OT-001231, OT-hPDE5-035) Fluc (N50D, N119G, S548I, K549A, L550V); linker (SG); hPDE5 (Amino acid 535-860 of WT, R732L; F736A); stop | MEDAKNIKKGPAPFYPLEDGTAGEQLHKAMKRYALVPGT IAFTDAHIEVDITYAEYFEMSVRLAEAMKRYGLNTNHRIV VCSENSLQFFMPVLGALFIGVAVAPANDIYNERELLNSMG ISQPTVVFVSKKGLQKILNVQKKLPIIQKIIIMDSKTDYQGF QSMYTFVTSHLPPGFNEYDFVPESFDRDKTIALIMNSSGST GLPKGVALPHRTACVRFSHARDPIFGNQIIPDTAILSVVPFH HGFGMFTTLGYLICGFRVVLMYRFEEELFLRSLQDYKIQS ALLVPTLFSFFAKSTLIDKYDLSNLHEIASGGAPLSKEVGE AVAKRFHLPGIRQGYGLTETTSAILITPEGDDKPGAVGKV VPPFFEAKVVDLDTGKTLGVNQRGELCVRGPMIMSGYVNN PEATNALIDKDGWLHSGDIAYWDEDEHFFIVDRLKSLIKY KGYQVAPAELESILLQHPNIFDAGVAGLPDDDAGELPAAV VVLEHGKTMTEKEIVDYVASQVTTAKKLRGGVVFVDEVP KGLTGKLDARKIREILIKAKKGGKIAVSGEETRELQSLAA AVVPSAQTLKITDFSFSDFELSDLETALCTIRMFTDLNLVQ NFQMKHEVLCRWILSVKKNYRKNVAYHNWRHAFNTAQ CMFAALKAGKIQNKLTDLEILALLIAALSHDLDHRGVNNS YIQRSEHPLAQLYCHSIMEHHHFDQCLMILNSPGNQILSGL SIEEYKTTLKIIKQAILATDLALYIKRLGEFAELIRKNQFNL EDPHQKELFLAMLMTACDLSAITKPWPIQQRIAELVATEF FDQGDRERKELNIEPTDLMNREKKNKIPSMQVGFIDAICL QLYEALTHVSEDCFPLLDGCRKNRQKWQALAEQQ* | 230 | 236 |
| OT-hPDE5-029 (OT-001225) Methionine; hPDE5 (Amino acid 535-860 of WT, R732L, F736A); Linker (SG); AcGFP (Amino acid 2-239 of WT); stop | MEETRELQSLAAAVVPSAQTLKITDFSFSDFELSDLETALC TIRMFTDLNLVQNFQMKHEVLCRWILSVKKNYRKNVAY HNWRHAFNTAQCMFAALKAGKIQNKLTDLEILALLIAAL SHDLDHRGVNNSYIQRSEHPLAQLYCHSIMEHHHFDQCL MILNSPGNQILSGLSIEEYKTTLKIIKQAILATDLALYIKRLG EFAELIRKNQFNLEDPHQKELFLAMLMTACDLSAITKPWP IQQRIAELVATEFFDQGDRERKELNIEPTDLMNREKKNKIP SMQVGFIDAICLQLYEALTHVSEDCFPLLDGCRKNRQKW QALAEQQSGVSKGAELFTGIVPILIELNGDVNGHKFSVSGE GEGDATYGKLTLKFICTTGKLPVPWPTLVTTLSYGVQCFS RYPDHMKQHDFFKSAMPEGYIQERTIFFEDDGNYKSRAE VKFEGDTLVNRIELTGTDFKEDGNILGNKMEYNYNAHNV YIMTDKAKNGIKVNFKIRHNIEDGSVQLADHYQQNTPIGD GPVLLPDNHYLSTQSALSKDPNEKRDHMIYFGFVTAAAIT HGMDELYK* | 511 | 526 |
| OT-hPDE5-030 (OT-001226) AcGFP (Amino acid 1-239 of WT); linker (SG); PDE5 (Amino acid 535-860 of WT, R732L, F736A); stop | MVSKGAELFTGIVPILIELNGDVNGHKFSVSGEGEGDATY GKLTLKFICTTGKLPVPWPTLVTTLSYGVQCFSRYPDHMK QHDFFKSAMPEGYIQERTIFFEDDGNYKSRAEVKFEGDTL VNRIELTGTDFKEDGNILGNKMEYNYNAHNVYIMTDKAK NGIKVNFKIRHNIEDGSVQLADHYQQNTPIGDGPVLLPDN HYLSTQSALSKDPNEKRDHMIYFGFVTAAAITHGMDELY KSGEETRELQSLAAAVVPSAQTLKITDFSFSDFELSDLETA LCTIRMFTDLNLVQNFQMKHEVLCRWILSVKKNYRKNVA YHNWRHAFNTAQCMFAALKAGKIQNKLTDLEILALLIAA LSHDLDHRGVNNSYIQRSEHPLAQLYCHSIMEHHHFDQCL MILNSPGNQILSGLSIEEYKTTLKIIKQAILATDLALYIKRLG EFAELIRKNQFNLEDPHQKELFLAMLMTACDLSAITKPWP IQQRIAELVATEFFDQGDRERKELNIEPTDLMNREKKNKIP SMQVGFIDAICLQLYEALTHVSEDCFPLLDGCRKNRQKW QALAEQQ* | 512 | 527 |
| OT-hPDE5-083 (OT-001205) AcGFP (Amino acid 1-239 of WT); linker (SG); hPDE5 (Amino acid 535-860 of WT, Y612F, R732L); stop | MVSKGAELFTGIVPILIELNGDVNGHKFSVSGEGEGDATY GKLTLKFICTTGKLPVPWPTLVTTLSYGVQCFSRYPDHMK QHDFFKSAMPEGYIQERTIFFEDDGNYKSRAEVKFEGDTL VNRIELTGTDFKEDGNILGNKMEYNYNAHNVYIMTDKAK NGIKVNFKIRHNIEDGSVQLADHYQQNTPIGDGPVLLPDN HYLSTQSALSKDPNEKRDHMIYFGFVTAAAITHGMDELY KSGEETRELQSLAAAVVPSAQTLKITDFSFSDFELSDLETA LCTIRMFTDLNLVQNFQMKHEVLCRWILSVKKNYRKNVA FHNWRHAFNTAQCMFAALKAGKIQNKLTDLEILALLIAA LSHDLDHRGVNNSYIQRSEHPLAQLYCHSIMEHHHFDQCL MILNSPGNQILSGLSIEEYKTTLKIIKQAILATDLALYIKRLG EFFELIRKNQFNLEDPHQKELFLAMLMTACDLSAITKPWPI QQRIAELVATEFFDQGDRERKELNIEPTDLMNREKKNKIPS MQVGFIDAICLQLYEALTHVSEDCFPLLDGCRKNRQKWQ ALAEQQ* | 513 | 528 |

TABLE 7-continued hPDE5 combination mutations

| Construct ID/ Description | Sequence | AA SEQ ID NO. | NA SEQ ID NO. |
|---|---|---|---|
| OT-hPDE5-084 (OT-001206) AcGFP (Amino acid 1-239 of WT); linker (SG); hPDE5 (Amino acid 535-860 of WT, Y612W, R732L); stop | MVSKGAELFTGIVPILIELNGDVNGHKFSVSGEGEGDATY GKLTLKFICTTGKLPVPWPTLVTTLSYGVQCFSRYPDHMK QHDFFKSAMPEGYIQERTIFFEDDGNYKSRAEVKFEGDTL VNRIELTGTDFKEDGNILGNKMEYNYNAHNVYIMTDKAK NGIKVNFKIRHNIEDGSVQLADHYQQNTPIGDGPVLLPDN HYLSTQSALSKDPNEKRDHMIYFGFVTAAAITHGMDELY KSGEETRELQSLAAAVVPSAQTLKITDFSFSDFELSDLETA LCTIRMFTDLNLVQNFQMKHEVLCRWILSVKKNYRKNVA WHNWRHAFNTAQCMFAALKAGKIQNKLTDLEILALLIAA LSHDLDHRGVNNSYIQRSEHPLAQLYCHSIMEHHHFDQCL MILNSPGNQILSGLSIEEYKTTLKIIKQAILATDLALYIKRLG EFFELIRKNQFNLEDPHQKELFLAMLMTACDLSAITKPWPI QQRIAELVATEFFDQGDRERKELNIEPTDLMNREKKNKIPS MQVGFIDAICLQLYEALTHVSEDCFPLLDGCRKNRQKWQ ALAEQQ* | 514 | 529 |
| OT-hPDE5-085 (OT-001207) AcGFP (Amino acid 1-239 of WT); linker (SG); hPDE5 (Amino acid 535-860 of WT, Y612A, R732L); stop | MVSKGAELFTGIVPILIELNGDVNGHKFSVSGEGEGDATY GKLTLKFICTTGKLPVPWPTLVTTLSYGVQCFSRYPDHMK QHDFFKSAMPEGYIQERTIFFEDDGNYKSRAEVKFEGDTL VNRIELTGTDFKEDGNILGNKMEYNYNAHNVYIMTDKAK NGIKVNFKIRHNIEDGSVQLADHYQQNTPIGDGPVLLPDN HYLSTQSALSKDPNEKRDHMIYFGFVTAAAITHGMDELY KSGEETRELQSLAAAVVPSAQTLKITDFSFSDFELSDLETA LCTIRMFTDLNLVQNFQMKHEVLCRWILSVKKNYRKNVA AHNWRHAFNTAQCMFAALKAGKIQNKLTDLEILALLIAA LSHDLDHRGVNNSYIQRSEHPLAQLYCHSIMEHHHFDQCL MILNSPGNQILSGLSIEEYKTTLKIIKQAILATDLALYIKRLG EFFELIRKNQFNLEDPHQKELFLAMLMTACDLSAITKPWPI QQRIAELVATEFFDQGDRERKELNIEPTDLMNREKKNKIPS MQVGFIDAICLQLYEALTHVSEDCFPLLDGCRKNRQKWQ ALAEQQ* | 515 | 530 |
| OT-hPDE5-090 (OT-001212) AcGFP (Amino acid 1-239 of WT); linker (SG); hPDE5 (Amino acid 535-860 of WT, H653A, R732L); stop | MVSKGAELFTGIVPILIELNGDVNGHKFSVSGEGEGDATY GKLTLKFICTTGKLPVPWPTLVTTLSYGVQCFSRYPDHMK QHDFFKSAMPEGYIQERTIFFEDDGNYKSRAEVKFEGDTL VNRIELTGTDFKEDGNILGNKMEYNYNAHNVYIMTDKAK NGIKVNFKIRHNIEDGSVQLADHYQQNTPIGDGPVLLPDN HYLSTQSALSKDPNEKRDHMIYFGFVTAAAITHGMDELY KSGEETRELQSLAAAVVPSAQTLKITDFSFSDFELSDLETA LCTIRMFTDLNLVQNFQMKHEVLCRWILSVKKNYRKNVA YHNWRHAFNTAQCMFAALKAGKIQNKLTDLEILALLIAA LSADLDHRGVNNSYIQRSEHPLAQLYCHSIMEHHHFDQCL MILNSPGNQILSGLSIEEYKTTLKIIKQAILATDLALYIKRLG EFFELIRKNQFNLEDPHQKELFLAMLMTACDLSAITKPWPI QQRIAELVATEFFDQGDRERKELNIEPTDLMNREKKNKIPS MQVGFIDAICLQLYEALTHVSEDCFPLLDGCRKNRQKWQ ALAEQQ* | 516 | 531 |
| OT-hPDE5-091 (OT-001213) AcGFP (Amino acid 1-239 of WT); linker (SG); hPDE5 (Amino acid 535-860 of WT, R732L, D764A); stop | MVSKGAELFTGIVPILIELNGDVNGHKFSVSGEGEGDATY GKLTLKFICTTGKLPVPWPTLVTTLSYGVQCFSRYPDHMK QHDFFKSAMPEGYIQERTIFFEDDGNYKSRAEVKFEGDTL VNRIELTGTDFKEDGNILGNKMEYNYNAHNVYIMTDKAK NGIKVNFKIRHNIEDGSVQLADHYQQNTPIGDGPVLLPDN HYLSTQSALSKDPNEKRDHMIYFGFVTAAAITHGMDELY KSGEETRELQSLAAAVVPSAQTLKITDFSFSDFELSDLETA LCTIRMFTDLNLVQNFQMKHEVLCRWILSVKKNYRKNVA YHNWRHAFNTAQCMFAALKAGKIQNKLTDLEILALLIAA LSHDLDHRGVNNSYIQRSEHPLAQLYCHSIMEHHHFDQCL MILNSPGNQILSGLSIEEYKTTLKIIKQAILATDLALYIKRLG EFFELIRKNQFNLEDPHQKELFLAMLMTACALSAITKPWPI QQRIAELVATEFFDQGDRERKELNIEPTDLMNREKKNKIPS MQVGFIDAICLQLYEALTHVSEDCFPLLDGCRKNRQKWQ ALAEQQ* | 517 | 532 |
| OT-hPDE5-094 (OT-001253) AcGFP (Amino acid 1-239 of WT); linker (SG); hPDE5 (Amino acid 535- | MVSKGAELFTGIVPILIELNGDVNGHKFSVSGEGEGDATY GKLTLKFICTTGKLPVPWPTLVTTLSYGVQCFSRYPDHMK QHDFFKSAMPEGYIQERTIFFEDDGNYKSRAEVKFEGDTL VNRIELTGTDFKEDGNILGNKMEYNYNAHNVYIMTDKAK NGIKVNFKIRHNIEDGSVQLADHYQQNTPIGDGPVLLPDN HYLSTQSALSKDPNEKRDHMIYFGFVTAAAITHGMDELY KSGEETRELQSLAAAVVPSAQTLKITDFSFSDFELSDLETA LCTIRMFTDLNLVQNFQMKHEVLCRWILSVKKNYRKNVA YHNWRHAFNTAQCMFAALKAGKIQNKLTDLEILALLIAA LSHDLDHRGVNNSYIQRSEHPLAQLYCHSIMEHHHFDQCL | 518 | 533 |

TABLE 7-continued hPDE5 combination mutations

| Construct ID/ Description | Sequence | AA SEQ ID NO. | NA SEQ ID NO. |
|---|---|---|---|
| 860 of WT; R732L); Xba I site (TCTAGA); stop | MILNSPGNQILSGLSIEEYKTTLKIIKQAILATDLALYIKRLG EFFELIRKNQFNLEDPHQKELFLAMLMTACDLSAITKPWPI QQRIAELVATEFFDQGDRERKELNIEPTDLMNREKKNKIPS MQVGFIDAICLQLYEALTHVSEDCFPLLDGCRKNRQKWQ ALAEQQSR* | | |

In some embodiments, any of the mutations described herein may be tested in the context of the truncated hPDE5 domains. As used herein truncated hPDE5 domains refers to regions and/or portions of hPDE5 of SEQ ID NO. 1, and are exemplified in Table 8. Also provided in Table 8 are the constructs utilizing the regions or portions of hPDE5, fused to AcGFP via linkers. In Table 8, translation of the stop codon is indicated by asterisk. Table 8 also provides alternate aliases for a given construct ID. These aliases are identified by the prefix OT.

TABLE 8 hPDE5 truncation constructs and its components

| Construct ID/ Description | Sequence | AA SEQ ID NO | NA SEQ ID NO |
|---|---|---|---|
| Methionine; hPDE5 (Amino acid 535-860 of WT) | MEETRELQSLAAAVVPSAQTLKITDFSFSDFELSDLETALCTIRM FTDLNLVQNFQMKHEVLCRWILSVKKNYRKNVAYHNWRHAFN TAQCMFAALKAGKIQNKLTDLEILALLIAALSHDLDHRGVNNSY IQRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 237 | 4 |
| Methionine; hPDE5 (Amino acid 535-860 of WT, R732L) | MEETRELQSLAAAVVPSAQTLKITDFSFSDFELSDLETALCTIRM FTDLNLVQNFQMKHEVLCRWILSVKKNYRKNVAYHNWRHAFN TAQCMFAALKAGKIQNKLTDLEILALLIAALSHDLDHRGVNNSY IQRSEHPLAQLYCHSIMEHHHFDQCLMILNSPGNQILSGLSIEEYK TTLKIIKQAILATDLALYIKRLGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 238 | 250 |
| Methionine; hPDE5 (Amino acid 535-836 of WT, R732L) | MEETRELQSLAAAVVPSAQTLKITDFSFSDFELSDLETALCTIRM FTDLNLVQNFQMKHEVLCRWILSVKKNYRKNVAYHNWRHAFN TAQCMFAALKAGKIQNKLTDLEILALLIAALSHDLDHRGVNNSY IQRSEHPLAQLYCHSIMEHHHFDQCLMILNSPGNQILSGLSIEEYK TTLKIIKQAILATDLALYIKRLGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVS | 239 | 251 |
| Methionine; hPDE5 (Amino acid 567-860 of WT, R732L) | MSDLETALCTIRMFTDLNLVQNFQMKHEVLCRWILSVKKNYRK NVAYHNWRHAFNTAQCMFAALKAGKIQNKLTDLEILALLIAAL SHDLDHRGVNNSYIQRSEHPLAQLYCHSIMEHHHFDQCLMILNS PGNQILSGLSIEEYKTTLKIIKQAILATDLALYIKRLGEFFELIRKN QFNLEDPHQKELFLAMLMTACDLSAITKPWPIQQRIAELVATEFF DQGDRERKELNIEPTDLMNREKKNKIPSMQVGFIDAICLQLYEA LTHVSEDCFPLLDGCRKNRQKWQALAEQQ | 240 | 252 |
| hPDE5 (Amino acid 590-860 of WT, R732L) | MKHEVLCRWILSVKKNYRKNVAYHNWRHAFNTAQCMFAALK AGKIQNKLTDLEILALLIAALSHDLDHRGVNNSYIQRSEHPLAQL YCHSIMEHHHFDQCLMILNSPGNQILSGLSIEEYKTTLKIIKQAIL ATDLALYIKRLGEFFELIRKNQFNLEDPHQKELFLAMLMTACDL SAITKPWPIQQRIAELVATEFFDQGDRERKELNIEPTDLMNREKK NKIPSMQVGFIDAICLQLYEALTHVSEDCFPLLDGCRKNRQKWQ ALAEQQ | 241 | 253 |
| hPDE5 (Amino acid 590-836 of WT, R732L) | MKHEVLCRWILSVKKNYRKNVAYHNWRHAFNTAQCMFAALK AGKIQNKLTDLEILALLIAALSHDLDHRGVNNSYIQRSEHPLAQL YCHSIMEHHHFDQCLMILNSPGNQILSGLSIEEYKTTLKIIKQAIL ATDLALYIKRLGEFFELIRKNQFNLEDPHQKELFLAMLMTACDL SAITKPWPIQQRIAELVATEFFDQGDRERKELNIEPTDLMNREKK NKIPSMQVGFIDAICLQLYEALTHVS | 242 | 254 |

TABLE 8-continued hPDE5 truncation constructs and its components

| Construct ID/ Description | Sequence | AA SEQ ID NO | NA SEQ ID NO |
| --- | --- | --- | --- |
| hPDE5 (Amino acid 535-860 of WT) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLTAALSHDLDHRGVNNSYI QRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 3 | 339 |
| hPDE5 (Amino acid 535-860 of WT, R732L) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLTAALSHDLDHRGVNNSYI QRSEHPLAQLYCHSIMEHHHFDQCLMILNSPGNQILSGLSIEEYK TTLKIIKQAILATDLALYIKRLGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQ | 12 | 536 |
| hPDE5 (Amino acid 535-836 of WT, R732L) | EETRELQSLAAAVVPSAQTLKITDFSFSDFELSDLETALCTIRMFT DLNLVQNFQMKHEVLCRWILSVKKNYRKNVAYHNWRHAFNT AQCMFAALKAGKIQNKLTDLEILALLTAALSHDLDHRGVNNSYI QRSEHPLAQLYCHSIMEHHHFDQCLMILNSPGNQILSGLSIEEYK TTLKIIKQAILATDLALYIKRLGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVS | 534 | 537 |
| hPDE5 (Amino acid 567-860 of WT, R732L) | SDLETALCTIRMFTDLNLVQNFQMKHEVLCRWILSVKKNYRKN VAYHNWRHAFNTAQCMFAALKAGKIQNKLTDLEILALLIAALS HDLDHRGVNNSYIQRSEHPLAQLYCHSIMEHHHFDQCLMILNSP GNQILSGLSIEEYKTTLKIIKQAILATDLALYIKRLGEFFELIRKNQ FNLEDPHQKELFLAMLMTACDLSAITKPWPIQQRIAELVA1EFFD QGDRERKELNIEPTDLMNREKKNKIPSMQVGFIDAICLQLYEALT HVSEDCFPLLDGCRKNRQKWQALAEQQ | 535 | 538 |
| Linker (SG) | SG | — | AGT GGT |
| AcGFP | VSKGAELFTGIVPILIELNGDVNGHKFSVSGEGEGDATYGKLTLK FICTTGKLPVPWPTLVTTLSYGVQCFSRYPDHMKQHDFFKSAMP EGYIQERTIFFEDDGNYKSRAEVKFEGDTLVNRIELTGTDFKEDG NILGNKMEYNYNAHNVYIMTDKAKNGIKVNFKIRHNIEDGSVQ LADHYQQNTPIGDGPVLLPDNHYLSTQSALSKDPNEKRDHMIYF GFVTAAAITHGMDELYK | 79 | 372 |
| OT-hPDE5N-019 (OT-001216, OT-hPDE5-019) Methionine; hPDE5 (Amino acid 535-860 of WT); linker (SG); AcGFP (Amino acid 2-239 of WT); stop | MEETRELQSLAAAVVPSAQTLKITDFSFSDFELSDLETALCTIRM FTDLNLVQNFQMKHEVLCRWILSVKKNYRKNVAYHNWRHAFN TAQCMFAALKAGKIQNKLTDLEILALLIAALSHDLDHRGVNNSY IQRSEHPLAQLYCHSIMEHHHFDQCLMILNSPGNQILSGLSIEEYK TTLKIIKQAILATDLALYIKRRGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQSGVSKGAELFTGIVPILIELNGDVNGHKF SVSGEGEGDATYGKLTLKFICTTGKLPVPWPTLVTTLSYGVQCF SRYPDHMKQHDFFKSAMPEGYIQERTIFFEDDGNYKSRAEVKFE GDTLVNRIELTGTDFKEDGNILGNKMEYNYNAHNVYIMTDKAK NGIKVNFKIRHNIEDGSVQLADHYQQNTPIGDGPVLLPDNHYLS TQSALSKDPNEKRDHMIYFGFVTAAAITHGMDELYK* | 243 | 255 |
| OT-hPDE5N-020 (OT-001217, OT-hPDE5-020) Methionine; hPDE5 (Amino acid 535-860 of WT, R732L); | MEETRELQSLAAAVVPSAQTLKITDFSFSDFELSDLETALCTIRM FTDLNLVQNFQMKHEVLCRWILSVKKNYRKNVAYHNWRHAFN TAQCMFAALKAGKIQNKLTDLEILALLIAALSHDLDHRGVNNSY IQRSEHPLAQLYCHSIMEHHHFDQCLMILNSPGNQILSGLSIEEYK TTLKIIKQAILATDLALYIKRLGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSEDCFPLLDG CRKNRQKWQALAEQQSGVSKGAELFTGIVPILIELNGDVNGHKF SVSGEGEGDATYGKLTLKFICTTGKLPVPWPTLVTTLSYGVQCF SRYPDHMKQHDFFKSAMPEGYIQERTIFFEDDGNYKSRAEVKFE GDTLVNRIELTGTDFKEDGNILGNKMEYNYNAHNVYIMTDKAK | 244 | 256 |

TABLE 8-continued hPDE5 truncation constructs and its components

| Construct ID/ Description | Sequence | AA SEQ ID NO | NA SEQ ID NO |
|---|---|---|---|
| linker (SG); AcGFP; stop (Amino acid 2-239 of WT); stop | NGIKVNFKIRHNIEDGSVQLADHYQQNTPIGDGPVLLPDNHYLS TQSALSKDPNEKRDHMIYFGFVTAAAITHGMDELYK* | | |
| OT-hPDE5N-021 (OT-001218, OT-hPDE5-021) Methionine; hPDE5 (Amino acid 535-836 of WT, R732L); linker (SG); AcGFP (Amino acid 2-239 of WT); stop | MEETRELQSLAAAVVPSAQTLKITDFSFSDFELSDLETALCTIRM FTDLNLVQNFQMKHEVLCRWILSVKKNYRKNVAYHNWRHAFN TAQCMFAALKAGKIQNKLTDLEILALLIAALSHDLDHRGVNNSY IQRSEHPLAQLYCHSIMEHHHFDQCLMILNSPGNQILSGLSIEEYK TTLKIIKQAILATDLALYIKRLGEFFELIRKNQFNLEDPHQKELFL AMLMTACDLSAITKPWPIQQRIAELVATEFFDQGDRERKELNIEP TDLMNREKKNKIPSMQVGFIDAICLQLYEALTHVSSGVSKGAEL FTGIVPILIELNGDVNGHKFSVSGEGEGDATYGKLTLKFICTTGK LPVPWPTLVTTLSYGVQCFSRYPDHMKQHDFFKSAMPEGYIQER TIFFEDDGNYKSRAEVKFEGDTLVNRIELTGTDFKEDGNILGNK MEYNYNAHNVYIMTDKAKNGIKVNFKIRHNIEDGSVQLADHYQ QNTPIGDGPVLLPDNHYLSTQSALSKDPNEKRDHMIYFGFVTAA AITHGMDELYK* | 245 | 257 |
| OT-hPDE5N-022 (OT-001219, OT-hPDE5-022) Methionine; hPDE5 (Amino acid 567-860 of WT, R732L); linker (SG); AcGFP (Amino acid 2-239 of WT); stop | MSDLETALCTIRMFTDLNLVQNFQMKHEVLCRWILSVKKNYRK NVAYHNWRHAFNTAQCMFAALKAGKIQNKLTDLEILALLIAAL SHDLDHRGVNNSYIQRSEHPLAQLYCHSIMEHHHFDQCLMILNS PGNQILSGLSIEEYKTTLKIIKQAILATDLALYIKRLGEFFELIRKN QFNLEDPHQKELFLAMLMTACDLSAITKPWPIQQRIAELVATEFF DQGDRERKELNIEPTDLMNREKKNKIPSMQVGFIDAICLQLYEA LTHVSEDCFPLLDGCRKNRQKWQALAEQQSGVSKGAELFTGIV PILIELNGDVNGHKFSVSGEGEGDATYGKLTLKFICTTGKLPVPW PTLVTTLSYGVQCFSRYPDHMKQHDFFKSAMPEGYIQERTIFFED DGNYKSRAEVKFEGDTLVNRIELTGTDFKEDGNILGNKMEYNY NAHNVYIMTDKAKNGIKVNFKIRHNIEDGSVQLADHYQQNTPIG DGPVLLPDNHYLSTQSALSKDPNEKRDHMIYFGFVTAAAITHGM DELYK* | 246 | 258 |
| OT-hPDE5N-023 (OT-001220, OT-hPDE5-023) hPDE5 (Amino acid 590-860 of WT, R732L); linker (SG); AcGFP (Amino acid 2-239 of WT); stop | MKHEVLCRWILSVKKNYRKNVAYHNWRHAFNTAQCMFAALK AGKIQNKLTDLEILALLIAALSHDLDHRGVNNSYIQRSEHPLAQL YCHSIMEHHHFDQCLMILNSPGNQILSGLSIEEYKTTLKIIKQAIL ATDLALYIKRLGEFFELIRKNQFNLEDPHQKELFLAMLMTACDL SAITKPWPIQQRIAELVATEFFDQGDRERKELNIEPTDLMNREKK NKIPSMQVGFIDAICLQLYEALTHVSEDCFPLLDGCRKNRQKW QALAEQQSGVSKGAELFTGIVPILIELNGDVNGHKFSVSGEGEGD ATYGKLTLKFICTTGKLPVPWPTLVTTLSYGVQCFSRYPDHMKQ HDFFKSAMPEGYIQERTIFFEDDGNYKSRAEVKFEGDTLVNRIEL TGTDFKEDGNILGNKMEYNYNAHNVYIMTDKAKNGIKVNFKIR HNIEDGSVQLADHYQQNTPIGDGPVLLPDNHYLSTQSALSKDPN EKRDHMIYFGFVTAAAITHGMDELYK* | 247 | 259 |
| OT-hPDE5N-024 (OT-001221, OT-hPDE5-024) hPDE5 (Amino acid 590-836 of WT, R732L); linker (SG); AcGFP (Amino acid 2-239 of WT); stop | MKHEVLCRWILSVKKNYRKNVAYHNWRHAFNTAQCMFAALK AGKIQNKLTDLEILALLIAALSHDLDHRGVNNSYIQRSEHPLAQL YCHSIMEHHHFDQCLMILNSPGNQILSGLSIEEYKTTLKIIKQAIL ATDLALYIKRLGEFFELIRKNQFNLEDPHQKELFLAMLMTACDL SAITKPWPIQQRIAELVATEFFDQGDRERKELNIEPTDLMNREKK NKIPSMQVGFIDAICLQLYEALTHVSSGVSKGAELFTGIVPILIEL NGDVNGHKFSVSGEGEGDATYGKLTLKFICTTGKLPVPWPTLVT TLSYGVQCFSRYPDHMKQHDFFKSAMPEGYIQERTIFFEDDGNY KSRAEVKFEGDTLVNRIELTGTDFKEDGNILGNKMEYNYNAHN VYIMTDKAKNGIKVNFKIRHNIEDGSVQLADHYQQNTPIGDGPV LLPDNHYLSTQSALSKDPNEKRDHMIYFGFVTAAAITHGMDELY K* | 248 | 260 |

Stimulus

Biocircuits of the invention are triggered by one or more stimuli. Stimuli may be selected from a ligand, an externally added or endogenous metabolite, the presence or absence of a defined ligand, pH, temperature, light, ionic strength, radioactivity, cellular location, subject site, microenvironment, the presence or the concentration of one or more metal ions.

In some embodiments, the stimulus is a ligand. Ligands may be nucleic acid-based, protein-based, lipid based, organic, inorganic or any combination of the foregoing. In some embodiments, the ligand is selected from the group consisting of a protein, peptide, nucleic acid, lipid, lipid derivative, sterol, steroid, metabolite derivative and a small molecule. In some embodiments, the stimulus is a small molecule. In some embodiments, the small molecules are cell permeable. Ligands useful in the present invention include without limitation, any of those taught in Table 2 of co-owned U.S. Provisional Patent Application No. 62/320, 864 filed Apr. 11, 2016, 62/466,596 filed Mar. 3, 2017 and the International Publication WO2017/180587 (the contents of each of which are herein incorporated by reference in their entirety). In some embodiments, the small molecules are FDA-approved, safe and orally administered.

In some embodiments, the ligand binds to phosphodiesterases. In some embodiments, the ligand binds to and inhibits phosphodiesterase function and is herein referred to as a phosphodiesterase inhibitor.

In some embodiments, the ligand is a small molecule that binds to phosphodiesterase 5. In one embodiment, the small molecule is a hPDE5 inhibitor. Examples of hPDE5 inhibitors include, but are not limited to, Sildenafil, Vardenafil, Tadalafil, Avanafil, Lodenafil, Mirodenafil, Udenafil, Benzamidenafil, Dasantafil, Beminafil, SLx-2101, LAS 34179, UK-343,664, UK-357903, UK-371800, and BMS-341400.

In some embodiments, ligands include sildenafil-derived ligands containing portions of the ligand known to mediate binding to hPDE5. Ligands may also be modified to reduce off-target binding to Phosphodiesterases and increase specific binding to hPDE5.

hPDE5 inhibitors cover a broad pharmacokinetic space with respect to the approved dose and their duration of action and is described in Table 9. In Table 9, PO stands forper os (i.e. by mouth); QD represents quaque die (i.e. every day); IV represents intravenous; TID represents ter un die (i.e. three times a day); and Cmax represents the peak serum concentration that a drug achieves after its administration.

TABLE 9

Pharmacokinetics of hPDE5 inhibitors

| Drug | Approved Dose | Cmax | Duration of action |
| --- | --- | --- | --- |
| Sildenafil | PO: 100 mg QD or 20 mg TID IV: 10 mg TID | PO: 1 µM IV: 1 µM | 4-8 hrs |
| Vardenafil | PO: 20 mg QD | 0.1 µM | 2-8 hrs |
| Tadalafil | PO: 40 QD | 1.5 µM | 24-36 hrs |

In some embodiments, the ligand selection is determined by the magnitude and duration of expression of the effector modules of the invention using the PK parameters described in Table 9. In some embodiments, high levels of expression of the payload for a short duration of time may be desired. In such instances, vardenafil may be selected as the ligand.

In some embodiments, high levels of expression of the payload may be desired for a long duration. In such instances, the ligand, Tadalafil may be selected. In some embodiments, low levels of expression of the payload may be desired for a long duration of time. In such instances, Sildenafil may be selected as the ligand.

In some embodiments, additional hPDE5 inhibitors may be developed to show selectivity towards a specific phosphodiesterase protein; to reduce or increase the duration of treatment with the ligand; and to improve the rate of onset of the ligand.

Ligands may also be selected from the analysis of the dependence of a known hPDE5 ligand's activity on its molecular/chemical structure, through Structure Activity Relationships (SAR) study. Any of the methods related to SAR, known in art may be utilized to identify stabilizing ligands of the invention. SAR may be utilized to improve properties of the ligand such as specificity, potency, pharmacokinetics, bioavailability, and safety. SAR analysis of known hPDE5 inhibitors may also be combined with high resolution X ray structures of hPDE5 complexed with ligands. The X ray structure of hPDE5 co-crystallized with Sildenafil, Tadalafil, and Vardenafil have been studied and the binding mode of the inhibitors has been identified (Zhang, K. Y. J. et al. (2004) Mol. Cell., 15, 279; Card, G. L. et al. (2004) Structure. 12, 2233; the contents of each of which are incorporated herein by reference in their entirety). There are several classes of hPDE5 inhibitors described. These include aryl, beryl, heteroaryl or heterobiaryl classes with different scaffold structures. The aryl class includes substituted nitroanilines and the biaryl class includes substituted naphthalenes. The heterobiaryl and heterotriaryl are further sub classified based on its fused system into pyrazolopyrimidinones, triazolopyrimidinones, imidazotriazines, purines, pyrrolopyrimidinones, triazolotrizinones, isoxazolopyrimidinones, β-carbolines, pyrroloquinolones, isoquinolines, quinazolines, imidazoquinazolinones, pyrazolopyridines, pyrazolopyridopyrimidinones. These widely different chemical structures are suggested to have different orientation in the binding site of hPDE5 enzyme. Sildenafil has three main chemical groups, the pyrazolopyrimidinone ring, the ethoxyphenyl ring and the methylpiperazine ring. The pyrazolopyrimidinone group is responsible for the binding of the drug to its active binding site of hPDE5.

Many hPDE inhibitors act by competing with the substrate, cGMP, for the catalytic site of the enzyme. Sildenafil and Vardenafil differ in the heterocyclic ring system used to mimic the purine ring of cGMP. They also differ in the substituent (ethyl/methyl) of a piperazine side chain. Although these are the only structural differences, Vardenafil is more potent than Sildenafil. In some embodiments, the structural differences between different know inhibitors of hPDE may be utilized to design better hPDE inhibitor based ligands. For example, Corbin et al. synthesized an analog of sildenafil that contained the sildenafil ring system but with the appended ethyl group found in vardenafil; and an analog of vardenafil (dimethyl-vardenafil) that contained the vardenafil ring system but with the appended methyl group found in sildenafil was also generated. These studies identified that the ring systems play a critical role in higher potency of vardenafil over sildenafil (Corbin J D et al. (2004) Neurochem Int; 45(6):859-63; the contents of which are incorporated herein by reference in their entirety). Based on the X ray crystal structure of hPDE complexed with sildenafil, the active site region was defined as a sphere within the 6.5 Angstrom from the reference ligand, sildenafil. Surface hydrophobicity (lipophilicity) potential physicochemical property map of the hPDE5 active site may be generated based on this information. The ethoxyphenyl group of sildenafil fits into the hydrophobic pocket formed by Phe 786, Ala783, Leu804, and Val782, and the pyrazolopyrimidinone ring also forms hydrophobic interaction with the side chains of Val782, Tyr612, and Phe820 in the binding pocket.

New hPDE5 inhibitors may also be developed using a series of analogs of known hPDE5 inhibitors. 3D-Quantitative Structure activity analysis (QSAR), CoMFA (comparative molecular field analysis) and CoMSIA (comparative molecular similarity indices analysis) may be implemented for this purpose. In one embodiment, the structure of hPDE5 inhibitor may preferentially incorporate an N ethyl group in the pyrrolopyrimidinone ring at N5 position; and a propoxyphenyl group, which bear a substituent; one methylene unit longer, respectively in comparison with the corresponding positions of sildenafil. Any of the modifications to Sildenafil structure taught by Koo J et al. may be useful in the present invention (Koo J et al. (2007) Bioorg. & Med. Chem Lett 17; 4271-4274; the contents of which are incorporated by reference in their entirety).

In some embodiments, the stimulus may be a ligand that binds to more than one phosphodiesterase. In one embodiment, the stimulus is a pan phosphodiesterase inhibitor that may bind to two or more hPDEs such as Aminophyline, Paraxanthine, Pentoxifylline, Theobromine, Dipyridamole, Theophyline, Zaprinast, Icariin, CDP-840, Etazolate and Glaucine.

In some embodiments, the ligand is a hPDE1 inhibitor. Exemplary hPDE1 inhibitor, Vinpocetine may in some instances be used as the ligand in the present invention. In some embodiments, the ligand is a hPDE2 inhibitor. Exemplary hPDE2 inhibitors include EHNA (erythro-9-(2-hydroxy-3-nonyl) adenine), Oxindole, PDP and BAY 60-7550. Inhibitors that selectively inhibit a hPDE2 isoform may also be used, for example, substituted pyrido (2,3-b) pyrazines having a hPDE2A selective inhibitory action (See, e.g., U.S. Pat. No. 9,527,841; the contents of which are incorporated by reference in its entirety). In some embodiments, the ligand is a hPDE3 inhibitor. hPDE3 inhibitors useful in the invention include, but are not limited to Amrinone, Cilostazol, Milrinone, Enoximone, and Pimobendan. In some embodiments, the ligand is a hPDE4 inhibitor. Exemplary hPDE4 inhibitors include FDA approved small molecules such as, but not limited to AN2728 (4-[(1-hydroxy-1,3-dihydro-2,1-benzoxaborol-5-yl) oxy]benzonitrile), Apremilast/CC10004 (N-{2-[(1 S)-1-(3-Ethoxy-4-methoxyphenyl)-2-(methylsulfonyl)ethyl]-1,3-dioxo-2,3-dihydro-1H-isoindol-4-yl}acetamide), and Roflumilast. Other exemplary hPDE4 inhibitors include Other small molecules that inhibit hPDE4 also include E6005/RVT501, Cilomilast/SB-207, 499, Ibudilast (AV-411 or MN-166), Mesembrenone, Piclamilast/RP 73401, Rolipram, Atizoram/CP-80633, Arofylline, CC-1088, Catramilast, CGH-2466, Cipamfylline, Drotaverine, Filaminast/WAY-PDA 641, HT-0712, DNS-001, ICI-63197, Indimilast, Irsogladine/MN 1695, Lirimilast/BAY 19-8004, Oglemilast, Revamilast, Ro 20-1724, Ronomilast, GSK256066, DC-TA-46, AWD 12-281 and YM-976. Any of the hPDE4 inhibitors described in International Patent Publication No. WO2014078220A1 and US Patent Publication No. US20170129887A1 may be useful in the present invention (the contents of each of which are incorporated by reference in their entirety). In some embodiments, the ligand is a hPDE6 inhibitor. In some embodiments, the ligand is a hPDE7 inhibitor. Exemplary hPDE7 inhibitors, include BRL-50481(N, N,2-Trimethyl-5-nitrobenzenesulfonamide) and ASB 16165 (1H-Thieno(2,3-C) pyrazole-5-carboxamide, 1-cyclohexyl-N-(6-(4-hydroxy-1-piperidinyl)-3-pyridinyl)-3-methyl). In some embodiments, the ligand is a hPDE8 inhibitor such as PF-04957325 (Pfizer). In some embodiments, the ligand is a hPDE9 inhibitor. Exemplary hPDE9 inhibitors include, but are not limited to BAY73-6691 (1-(2-chlorophenyl)-6-[(2R)-3,3,3-trifluoro-2-methylpropyl]-1,5-dihydro-4H-pyrazolo[3,4-d] pyrimidine-4-one), PF-04447943 (6-[(3S,4S)-4-methyl-1-(pyrimidin-2-ylmethyl)pyrrolidin-3-yl]-1-(oxan-4-yl)-2H-pyrazolo[3,4-d]pyrimidin-4-one) and WYQ-C28L. In some embodiments, the ligand is a hPDE10 inhibitor. Exemplary PDE10 inhibitors include, but are not limited to OMS 824, Papaverine and PF-2545920 (2-(4-(1-methyl-4-pyridin-4-yl-1H-pyrazol-3-yl) phenoxymethyl) quinolone), and GS-5759 (Gilead).

In one embodiment, the stimuli of the present invention may be FDA approved ligands capable of binding to the specific DDs or target regions within the DDs. In other embodiments, FDA approved ligands may be used to screen potential binders in the human protein. DDs may be designed based on the positive hits from the screen using the portion of the protein that binds to the ligand. In one embodiment, proteins that bind to FDA approved ligands as off target interactions may be used to design DDs of the present invention.

In some embodiments, ligands that do not affect the activity of the immune cell, and/or the chimeric antigen receptor, in the absence of the SREs may be preferably selected.

Stabilizing Domains

In some embodiments, the stimulus response element may be stabilized in the absence of the stimulus but destabilized by the stimulus. In some embodiments, SREs may be derived from protein complexes that comprise at least one protein-protein interaction. In other aspects, the SRE may form a protein-protein interaction with a natural protein within the cell. Protein complexes reduce the exposure of the constituent proteins to the risk of undesired oligomerization by reducing the concentration of the free monomeric state. Payloads appended to such SREs may stabilized in the absence of the stimulus. In some aspects, the stimulus may be a small molecule that is capable of interrupting or disrupting the protein-protein interactions related to the SRE. In such instances, addition of the stimulus, results in the reduced expression and/or function of the payload. In some embodiments, stimuli that induce conformational change of the SRE may be utilized. In one aspect, the SRE may be stabilized by the conformational change. In another aspect, the SRE may be destabilized by the conformational change. The stimuli may also be small molecules that disrupt post translational modification of SREs which may result in the disruption of the protein-protein interaction related to the SRE. In some embodiments, SREs may be identified using protein interactomic techniques known in the art. Such methods may enable the identification of protein interactions that are therapeutically relevant. Any of the large-scale quantitative proteomics methods described in International Patent Publication NOs. WO2017210427A1, WO2016196994A9, and WO2014200987A3 may be useful in the present invention (the contents of each of which are incorporated by reference in their entirety).

Payloads

In some embodiments, payloads can be any natural protein in an organism genome, a fusion polypeptide, an antibody, or variants, mutants and derivatives thereof. In some embodiments, the effector module of the present invention is a fusion construct comprising a DD of the invention operably linked to at least one payload. In one aspect, the payload may be any natural protein of interest (POI) or variants thereof, an antibody or fragments thereof, a therapeutic agent, or any artificial peptide or polypeptide.

In some embodiments, payloads of the present invention may be immunotherapeutic agents. As used herein, an immunotherapeutic agent is any agent that induces immune responses in an organism. An immunotherapeutic agent may be a natural protein in an organism or it may be an artificial protein such as a fusion protein or an antibody. The immunotherapeutic agent may be, but is not limited to, an antibody and fragments and variants thereof, a MHC molecule, an antigen and fragments thereof, a T cell receptor (TCR) such as a tumor specific TCR and variants thereof, a chimeric antigen receptor (CAR), a chimeric switch receptor, a co-stimulatory molecule, a co-inhibitory molecule, an inhibitor of a co-inhibitory receptor or ligand, an agonist of a co-stimulatory receptor and ligand, a cytokine, chemokine, a cytokine receptor, a chemokine receptor, a soluble growth factor, a metabolic factor, a homing receptor, a safety switch (e.g., a suicide gene), or any agent that induces an immune response. In one embodiment, the immunotherapeutic agent induces an anti-cancer immune response in a cell, or in a subject. In some aspects, the immunotherapeutic agent reduces the tumor burden in a subject.

The payload may be any immunotherapeutic agent used for cancer immunotherapy such as a T cell receptor (TCR), a chimeric agent receptor (CAR) such as CD19 CAR that targets any molecule of tumor cells, an antibody, an antigen binding domain or combination of antigen binding domains, a cytokine such as IL2, IL12, IL 15 or IL 15/IL15Ra fusion, an antagonist of an immune checkpoint, an agonist of co-stimulatory molecule, a chimeric switch receptor, a safety switch, a metabolic factor, a growth factor, a chemokine, a chemokine receptor, a homing receptor, or any agent that can induce an immune response. The SRE and payload may be operably linked through one or more linkers and the positions of components may vary within the effector module.

1. Protein of Interest

In some embodiments, payloads of the invention may be a natural protein in an organism genome, or variants, mutants, derivatives thereof. The natural protein may be from, for example, a mammalian organism, a bacterium, and a virus.

In one example, the payload may be a protein of interest, or a polypeptide from human genome.

2. Antibodies

In some embodiments, antibodies, fragments and variants thereof are payloads of the present invention. The antibody may be an intact antibody, an antibody light chain, antibody heavy chain, an antibody fragment, an antibody variant, or an antibody derivative.

In some embodiments, payloads of the invention may be an antibody or fragments thereof. Antibodies useful in this method include without limitation, any of those taught in co-owned U.S. Provisional Patent Application No. 62/320,864 filed Apr. 11, 2016, 62/466,596 filed Mar. 3, 2017 and the International Publication WO2017/180587 (the contents of each of which are herein incorporated by reference in their entirety).

Antibody Fragments and Variants

In some embodiments, antibody fragments and variants may comprise antigen binding regions from intact antibodies. Examples of antibody fragments and variants may include, but are not limited to Fab, Fab', F(ab')2, and Fv fragments; diabodies; linear antibodies; single-chain antibody molecules such as single chain variable fragment (scFv); and multispecific antibodies formed from antibody fragments. Papain digestion of antibodies produces two identical antigen-binding fragments, called "Fab" fragments, each with a single antigen-binding site. Also produced is a residual "Fc" fragment, whose name reflects its ability to crystallize readily. Pepsin treatment yields an F(ab')2 fragment that has two antigen-binding sites and is still capable of cross-linking with the antigen. Pharmaceutical compositions, biocircuits, biocircuit components, effector modules including their SREs or payloads of the present invention may comprise one or more of these fragments.

For the purposes herein, an "antibody" may comprise a heavy and light variable domain as well as an Fc region. As used herein, the term "native antibody" usually refers to a heterotetrameric glycoprotein of about 150,000 daltons, composed of two identical light (L) chains and two identical heavy (H) chains. Genes encoding antibody heavy and light chains are known and segments making up each have been well characterized and described (Matsuda et al., *The Journal of Experimental Medicine.* 1998, 188(11): 2151-62 and Li et al., *Blood,* 2004, 103(12): 4602-4609; the content of each of which are herein incorporated by reference in their entirety). Each light chain is linked to a heavy chain by one covalent disulfide bond, while the number of disulfide linkages varies among the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end; the constant domain of the light chain is aligned with the first constant domain of the heavy chain, and the light chain variable domain is aligned with the variable domain of the heavy chain.

As used herein, the term "variable domain" refers to specific antibody domains found on both the antibody heavy and light chains that differ extensively in sequence among antibodies and are used in the binding and specificity of each particular antibody for its particular antigen. Variable domains comprise hypervariable regions. As used herein, the term "hypervariable region" refers to a region within a variable domain comprising amino acid residues responsible for antigen binding. The amino acids present within the hypervariable regions determine the structure of the complementarity determining regions (CDRs) that become part of the antigen-binding site of the antibody. As used herein, the term "CDR" refers to a region of an antibody comprising a structure that is complimentary to its target antigen or epitope. Other portions of the variable domain, not interacting with the antigen, are referred to as framework (FW) regions. The antigen-binding site (also known as the antigen combining site or paratope) comprises the amino acid residues necessary to interact with a particular antigen. The exact residues making up the antigen-binding site are typically elucidated by co-crystallography with bound antigen, however computational assessments based on comparisons with other antibodies can also be used (Strohl, W. R. Therapeutic Antibody Engineering. Woodhead Publishing, Philadelphia Pa. 2012. Ch. 3, p 47-54, the contents of which are herein incorporated by reference in their entirety). Determining residues that make up CDRs may include the use of numbering schemes including, but not limited to, those taught by Kabat (Wu et al., *JEM,* 1970, 132(2):211-250 and Johnson et al., *Nucleic Acids Res.* 2000, 28(1): 214-218, the contents of each of which are herein incorporated by reference in their entirety), Chothia (Chothia and Lesk, *J. Mol.*

Biol. 1987, 196, 901, Chothia et al., *Nature,* 1989, 342, 877, and Al-Lazikani et al., *J. Mol. Biol.* 1997, 273(4): 927-948, the contents of each of which are herein incorporated by reference in their entirety), Lefranc (Lefranc et al., *Immunome Res.* 2005, 1:3) and Honegger (Honegger and Pluckthun, *J. Mol. Biol.* 2001, 309(3): 657-70, the contents of which are herein incorporated by reference in their entirety).

VH and VL domains have three CDRs each. VL CDRs are referred to herein as CDR-L1, CDR-L2 and CDR-L3, in order of occurrence when moving from N- to C-terminus along the variable domain polypeptide. VH CDRs are referred to herein as CDR-H1, CDR-H2 and CDR-H3, in order of occurrence when moving from N- to C-terminus along the variable domain polypeptide. Each of CDRs has favored canonical structures with the exception of the CDR-H3, which comprises amino acid sequences that may be highly variable in sequence and length between antibodies resulting in a variety of three-dimensional structures in antigen-binding domains (Nikoloudis, et al., *PeerJ.* 2014, 2: e456). In some cases, CDR-H3s may be analyzed among a panel of related antibodies to assess antibody diversity. Various methods of determining CDR sequences are known in the art and may be applied to known antibody sequences (Strohl, W. R. Therapeutic Antibody Engineering. Woodhead Publishing, Philadelphia Pa. 2012. Ch. 3, p 47-54, the contents of which are herein incorporated by reference in their entirety).

As used herein, the term "Fv" refers to an antibody fragment comprising the minimum fragment on an antibody needed to form a complete antigen-binding site. These regions consist of a dimer of one heavy chain and one light chain variable domain in tight, non-covalent association. Fv fragments can be generated by proteolytic cleavage, but are largely unstable. Recombinant methods are known in the art for generating stable Fv fragments, typically through insertion of a flexible linker between the light chain variable domain and the heavy chain variable domain (to form a single chain Fv (scFv)) or through the introduction of a disulfide bridge between heavy and light chain variable domains (Strohl, W. R. Therapeutic Antibody Engineering. Woodhead Publishing, Philadelphia Pa. 2012. Ch. 3, p 46-47, the contents of which are herein incorporated by reference in their entirety).

As used herein, the term "light chain" refers to a component of an antibody from any vertebrate species assigned to one of two clearly distinct types, called kappa and lambda based on amino acid sequences of constant domains. Depending on the amino acid sequence of the constant domain of their heavy chains, antibodies can be assigned to different classes. There are five major classes of intact antibodies: IgA, IgD, IgE, IgG, and IgM, and several of these may be further divided into subclasses (isotypes), e.g., IgG1, IgG2, IgG3, IgG4, IgA, and IgA2.

As used herein, the term "single chain Fv" or "scFv" refers to a fusion protein of VH and VL antibody domains, wherein these domains are linked together into a single polypeptide chain by a flexible peptide linker. In some embodiments, the Fv polypeptide linker enables the scFv to form the desired structure for antigen binding. In some embodiments, scFvs are utilized in conjunction with phage display, yeast display or other display methods where they may be expressed in association with a surface member (e.g. phage coat protein) and used in the identification of high affinity peptides for a given antigen.

Using molecular genetics, two scFvs can be engineered in tandem into a single polypeptide, separated by a linker domain, called a "tandem scFv" (tascFv). Construction of a tascFv with genes for two different scFvs yields a "bispecific single-chain variable fragments" (bis-scFvs). Only two tascFvs have been developed clinically by commercial firms; both are bispecific agents in active early phase development by Micromet for oncologic indications, and are described as "Bispecific T-cell Engagers (BiTE)." Blinatumomab is an anti-CD19/anti-CD3 bispecific tascFv that potentiates T-cell responses to B-cell non-Hodgkin lymphoma in Phase 2. MT110 is an anti-EP-CAM/anti-CD3 bispecific tascFv that potentiates T-cell responses to solid tumors in Phase 1. Bispecific, tetravalent "TandAbs" are also being researched by Affimed (Nelson, A. L., MAbs., 2010, January-February; 2(1):77-83). maxibodies (bivalent scFv fused to the amino terminus of the Fc (CH2-CH3 domains) of IgG may also be included.

As used herein, the term "bispecific antibody" refers to an antibody capable of binding two different antigens. Such antibodies typically comprise regions from at least two different antibodies. Bispecific antibodies may include any of those described in Riethmuller, G. *Cancer Immunity.* 2012, 12:12-18, Marvin et al., 2005. *Acta Pharmacologica Sinica.* 2005, 26(6): 649-658 and Schaefer et al., *PNAS.* 2011, 108(27):11187-11192, the contents of each of which are herein incorporated by reference in their entirety. In some aspects, bispecific antibodies may be trifunctional antibodies (3funct) and BiTE (bi-specific T cell engager).

As used herein, the term "diabody" refers to a small antibody fragment with two antigen-binding sites. Diabodies are functional bispecific single-chain antibodies (bscAb). Diabodies comprise a heavy chain variable domain VH connected to a light chain variable domain VL in the same polypeptide chain. By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al. (Hollinger, P. et al., "Diabodies": Small bivalent and bispecific antibody fragments. *PNAS,* 1993. 90: 6444-6448); the contents of each of which are incorporated herein by reference in their entirety.

The term "intrabody" refers to a form of antibody that is not secreted from a cell in which it is produced, but instead targets one or more intracellular proteins. Intrabodies may be used to affect a multitude of cellular processes including, but not limited to intracellular trafficking, transcription, translation, metabolic processes, proliferative signaling and cell division. In some embodiments, methods of the present invention may include intrabody-based therapies. In some such embodiments, variable domain sequences and/or CDR sequences disclosed herein may be incorporated into one or more constructs for intrabody-based therapy.

As used herein, the term "monoclonal antibody" refers to an antibody obtained from a population of substantially homogeneous cells (or clones), i.e., the individual antibodies comprising the population are identical and/or bind the same epitope, except for possible variants that may arise during production of the monoclonal antibodies, such variants generally being present in minor amounts. In contrast to polyclonal antibody preparations that typically include different antibodies directed against different determinants (epitopes), each monoclonal antibody is directed against a single determinant on the antigen.

The modifier "monoclonal" indicates the character of the antibody as being obtained from a substantially homogeneous population of antibodies, and is not to be construed as requiring production of the antibody by any particular method. The monoclonal antibodies herein include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies.

As used herein, the term "humanized antibody" refers to a chimeric antibody comprising a minimal portion from one or more non-human (e.g., murine) antibody source(s) with the remainder derived from one or more human immunoglobulin sources. For the most part, humanized antibodies are human immunoglobulins (recipient antibody) in which residues from the hypervariable region from an antibody of the recipient are replaced by residues from the hypervariable region from an antibody of a non-human species (donor antibody) such as mouse, rat, rabbit or nonhuman primate having the desired specificity, affinity, and/or capacity. In one embodiment, the antibody may be a humanized full-length antibody. As a non-limiting example, the antibody may have been humanized using the methods taught in US Patent Publication NO. US20130303399, the contents of which are herein incorporated by reference in its entirety.

As used herein, the term "antibody variant" refers to a modified antibody (in relation to a native or starting antibody) or a biomolecule resembling a native or starting antibody in structure and/or function (e.g., an antibody mimetic). Antibody variants may be altered in their amino acid sequence, composition or structure as compared to a native antibody. Antibody variants may include, but are not limited to, antibodies with altered isotypes (e.g., IgA, IgD, IgE, IgG1, IgG2, IgG3, IgG4, or IgM), humanized variants, optimized variants, multispecific antibody variants (e.g., bispecific variants), and antibody fragments.

In some embodiments, pharmaceutical compositions, biocircuits, biocircuit components, effector modules including their SREs or payloads of the present invention may be antibody mimetics. As used herein, the term "antibody mimetic" refers to any molecule which mimics the function or effect of an antibody and which binds specifically and with high affinity to their molecular targets. In some embodiments, antibody mimetics may be monobodies, designed to incorporate the fibronectin type III domain (Fn3) as a protein scaffold (U.S. Pat. Nos. 6,673,901; 6,348,584). In some embodiments, antibody mimetics may be those known in the art including, but are not limited to affibody molecules, affilins, affitins, anticalins, avimers, Centyrins, DARPINS™, Fynomers and Kunitz and domain peptides. In other embodiments, antibody mimetics may include one or more non-peptide regions.

In one embodiment, the antibody may comprise a modified Fc region. As a non-limiting example, the modified Fc region may be made by the methods or may be any of the regions described in US Patent Publication NO. US20150065690, the contents of which are herein incorporated by reference in its entirety.

In some embodiments, payloads of the invention may encode multispecific antibodies that bind more than one epitope. As used herein, the terms "multibody" or "multispecific antibody" refer to an antibody wherein two or more variable regions bind to different epitopes. The epitopes may be on the same or different targets. In one embodiment, the multispecific antibody may be generated and optimized by the methods described in International Patent Publication NO. WO2011109726 and US Patent Publication NO. US20150252119, the contents of which each of which are herein incorporated by reference in their entirety. These antibodies are able to bind to multiple antigens with high specificity and high affinity.

In certain embodiments, a multi-specific antibody is a "bispecific antibody" which recognizes two different epitopes on the same or different antigens. In one aspect, bispecific antibodies are capable of binding two different antigens. Such antibodies typically comprise antigen-binding regions from at least two different antibodies. For example, a bispecific monoclonal antibody (BsMAb, BsAb) is an artificial protein composed of fragments of two different monoclonal antibodies, thus allowing the BsAb to bind to two different types of antigen. Bispecific antibody frameworks may include any of those described in Riethmuller, G., 2012. Cancer Immunity, 2012, 12:12-18; Marvin et al., Acta Pharmacologica Sinica. 2005, 26(6):649-658; and Schaefer et al., PNAS. 2011, 108(27): 11187-11192, the contents of each of which are herein incorporated by reference in their entirety. New generations of BsMAb, called "trifunctional bispecific" antibodies, have been developed. These consist of two heavy and two light chains, one each from two different antibodies, where the two Fab regions (the arms) are directed against two antigens, and the Fc region (the foot) comprises the two heavy chains and forms the third binding site.

In some embodiments, payloads may encode antibodies comprising a single antigen-binding domain. These molecules are extremely small, with molecular weights approximately one-tenth of those observed for full-sized mAbs. Further antibodies may include "nanobodies" derived from the antigen-binding variable heavy chain regions (VHHs) of heavy chain antibodies found in camels and llamas, which lack light chains (Nelson, A. L., MAbs. 2010. January-February; 2(1):77-83).

In some embodiments, the antibody may be "miniaturized". Among the best examples of mAb miniaturization are the small modular immunopharmaceuticals (SMIPs) from Trubion Pharmaceuticals. These molecules, which can be monovalent or bivalent, are recombinant single-chain molecules containing one VL, one VH antigen-binding domain, and one or two constant "effector" domains, all connected by linker domains. Presumably, such a molecule might offer the advantages of increased tissue or tumor penetration claimed by fragments while retaining the immune effector functions conferred by constant domains. At least three "miniaturized" SMIPs have entered clinical development. TRU-015, an anti-CD20 SMIP developed in collaboration with Wyeth, is the most advanced project, having progressed to Phase 2 for rheumatoid arthritis (RA). Earlier attempts in systemic lupus erythrematosus (SLE) and B cell lymphomas were ultimately discontinued. Trubion and Facet Biotechnology are collaborating in the development of TRU-016, an anti-CD37 SMIP, for the treatment of CLL and other lymphoid neoplasias, a project that has reached Phase 2. Wyeth has licensed the anti-CD20 SMIP SBI-087 for the treatment of autoimmune diseases, including RA, SLE and possibly multiple sclerosis, although these projects remain in the earliest stages of clinical testing. (Nelson, A. L., MAbs, 2010. January-February; 2(1):77-83).

On example of miniaturized antibodies is called "unibody" in which the hinge region has been removed from IgG4 molecules. While IgG4 molecules are unstable and can exchange light-heavy chain heterodimers with one another, deletion of the hinge region prevents heavy chain-heavy chain pairing entirely, leaving highly specific monovalent light/heavy heterodimers, while retaining the Fc region to ensure stability and half-life in vivo. This configuration may minimize the risk of immune activation or oncogenic growth, as IgG4 interacts poorly with FcRs and monovalent unibodies fail to promote intracellular signaling complex formation (see, e.g., Nelson, A. L., MAbs, 2010. January-February; 2(1):77-83).

In some embodiments, payloads of the invention may encode single-domain antibodies (sdAbs, or nanobodies) which are antibody fragment consisting of a single monomeric variable antibody domain. Like a whole antibody, it is able to bind selectively to a specific antigen. In one aspect, a sdAb may be a "Camel Ig or "camelid VHH". As used herein, the term "camel Ig" refers to the smallest known antigen-binding unit of a heavy chain antibody (Koch-Nolte, et al, FASEB J., 2007, 21: 3490-3498). A "heavy chain antibody" or a "camelid antibody" refers to an antibody that contains two VH domains and no light chains (Riechmann L. et al, J. Immunol. Methods, 1999, 231: 25-38; International patent publication NOs.: WO1994/04678 and WO1994/025591; and U.S. Pat. No. 6,005,079). In another aspect, a sdAb may be a "immunoglobulin new antigen receptor" (IgNAR). As used herein, the term "immunoglobulin new antigen receptor" refers to class of antibodies from the shark immune repertoire that consist of homodimers of one variable new antigen receptor (VNAR) domain and five constant new antigen receptor (CNAR) domains. IgNARs represent some of the smallest known immunoglobulin-based protein scaffolds and are highly stable and possess efficient binding characteristics. The inherent stability can be attributed to both (i) the underlying Ig scaffold, which presents a considerable number of charged and hydrophilic surface exposed residues compared to the conventional antibody VH and VL domains found in murine antibodies; and (ii) stabilizing structural features in the complementary determining region (CDR) loops including inter-loop disulphide bridges, and patterns of intra-loop hydrogen bonds.

In some embodiments, payloads of the invention may encode intrabodies. Intrabodies are a form of antibody that is not secreted from a cell in which it is produced, but instead targets one or more intracellular proteins. Intrabodies are expressed and function intracellularly, and may be used to affect a multitude of cellular processes including, but not limited to intracellular trafficking, transcription, translation, metabolic processes, proliferative signaling and cell division. In some embodiments, methods described herein include intrabody-based therapies. In some such embodiments, variable domain sequences and/or CDR sequences disclosed herein are incorporated into one or more constructs for intrabody-based therapy. For example, intrabodies may target one or more glycated intracellular proteins or may modulate the interaction between one or more glycated intracellular proteins and an alternative protein.

The intracellular expression of intrabodies in different compartments of mammalian cells allows blocking or modulation of the function of endogenous molecules (Biocca, et al., EMBO J. 1990, 9: 101-108; Colby et al., Proc. Natl. Acad. Sci. U.S.A. 2004, 101: 17616-17621). Intrabodies can alter protein folding, protein-protein, protein-DNA, protein-RNA interactions and protein modification. They can induce a phenotypic knockout and work as neutralizing agents by direct binding to the target antigen, by diverting its intracellular trafficking or by inhibiting its association with binding partners. With high specificity and affinity to target antigens, intrabodies have advantages to block certain binding interactions of a particular target molecule, while sparing others.

Sequences from donor antibodies may be used to develop intrabodies. Intrabodies are often recombinantly expressed as single domain fragments such as isolated VH and VL domains or as a single chain variable fragment (scFv) antibody within the cell. For example, intrabodies are often expressed as a single polypeptide to form a single chain antibody comprising the variable domains of the heavy and light chains joined by a flexible linker polypeptide. Intrabodies typically lack disulfide bonds and are capable of modulating the expression or activity of target genes through their specific binding activity. Single chain intrabodies are often expressed from a recombinant nucleic acid molecule and engineered to be retained intracellularly (e.g., retained in the cytoplasm, endoplasmic reticulum, or periplasm). Intrabodies may be produced using methods known in the art, such as those disclosed and reviewed in: (Marasco et al., PNAS, 1993, 90: 7889-7893; Chen et al., Hum. Gene Ther. 1994, 5:595-601; Chen et al., 1994, PNAS, 91: 5932-5936; Maciejewski et al., 1995, Nature Med., 1: 667-673; Marasco, 1995, Immunotech, 1: 1-19; Mhashilkar, et al., 1995, EMBO J. 14: 1542-51; Chen et al., 1996, Hum. Gene Therap., 7: 1515-1525; Marasco, Gene Ther. 4:11-15, 1997; Rondon and Marasco, 1997, Annu. Rev. Microbiol. 51:257-283; Cohen, et al., 1998, Oncogene 17:2445-56; Proba et al., 1998, J. Mol. Biol. 275:245-253; Cohen et al., 1998, Oncogene 17:2445-2456; Hassanzadeh, et al., 1998, FEBS Lett. 437:81-6; Richardson et al., 1998, Gene Ther. 5:635-44; Ohage and Steipe, 1999, J. Mol. Biol. 291:1119-1128; Ohage et al., 1999, J. Mol. Biol. 291:1129-1134; Wirtz and Steipe, 1999, Protein Sci. 8:2245-2250; Zhu et al., 1999, J. Immunol. Methods 231:207-222; Arafat et al., 2000, Cancer Gene Ther. 7:1250-6; der Maur et al., 2002, J. Biol. Chem. 277:45075-85; Mhashilkar et al., 2002, Gene Ther. 9:307-19; and Wheeler et al., 2003, FASEB J. 17: 1733-5; and references cited therein).

In some embodiments, payloads of the invention may encode biosynthetic antibodies as described in U.S. Pat. No. 5,091,513, the contents of which are herein incorporated by reference in their entirety. Such antibody may include one or more sequences of amino acids constituting a region which behaves as a biosynthetic antibody binding site (BABS). The sites comprise 1) non-covalently associated or disulfide bonded synthetic VH and VL dimers, 2) VH-VL or VL-VH single chains wherein the VH and VL are attached by a polypeptide linker, or 3) individuals VH or VL domains. The binding domains comprise linked CDR and FR regions, which may be derived from separate immunoglobulins. The biosynthetic antibodies may also include other polypeptide sequences which function, e.g., as an enzyme, toxin, binding site, or site of attachment to an immobilization media or radioactive atom. Methods are disclosed for producing the biosynthetic antibodies, for designing BABS having any specificity that can be elicited by in vivo generation of antibody, and for producing analogs thereof.

In some embodiments, payloads may encode antibodies with antibody acceptor frameworks taught in U.S. Pat. No. 8,399,625. Such antibody acceptor frameworks may be particularly well suited accepting CDRs from an antibody of interest.

In one embodiment, the antibody may be a conditionally active biologic protein. An antibody may be used to generate a conditionally active biologic protein which are reversibly or irreversibly inactivated at the wild type normal physiological conditions as well as to such conditionally active biologic proteins and uses of such conditional active biologic proteins are provided. Such methods and conditionally active proteins are taught in, for example, International Publication No. WO2015175375 and WO2016036916 and US Patent Publication No. US20140378660, the contents of each of which are incorporated herein by reference in their entirety.

Antibody Preparations

The preparation of antibodies, whether monoclonal or polyclonal, is known in the art. Techniques for the production of antibodies are well known in the art and described, e.g. in Harlow and Lane "Antibodies, A Laboratory Manual", Cold Spring Harbor Laboratory Press, 1988; Harlow and Lane "Using Antibodies: A Laboratory Manual" Cold Spring Harbor Laboratory Press, 1999 and "Therapeutic Antibody Engineering: Current and Future Advances Driving the Strongest Growth Area in the Pharmaceutical Industry" Woodhead Publishing, 2012.

The antibodies and fragments and variants thereof as described herein can be produced using recombinant polynucleotides. In one embodiment, the polynucleotides have a modular design to encode at least one of the antibodies, fragments or variants thereof. As a non-limiting example, the polynucleotide construct may encode any of the following designs: (1) the heavy chain of an antibody, (2) the light chain of an antibody, (3) the heavy and light chain of the antibody, (4) the heavy chain and light chain separated by a linker, (5) the VH1, CH1, CH2, CH3 domains, a linker and the light chain or (6) the VH1, CH1, CH2, CH3 domains, VL region, and the light chain. Any of these designs may also comprise optional linkers between any domain and/or region. The polynucleotides of the present invention may be engineered to produce any standard class of immunoglobulins using an antibody described herein or any of its component parts as a starting molecule.

Antibodies Used for Immunotherapy

In some embodiments, payloads of the present invention may be antibodies, fragments and variants thereof which are specific to tumor specific antigens (TSAs) and tumor associated antigens (TAAs). Antibodies circulate throughout the body until they find and attach to the TSA/TAA. Once attached, they recruit other parts of the immune system, increasing ADCC (antibody dependent cell-mediated cytotoxicity) and ADCP (antibody dependent cell-mediated phagocytosis) to destroy tumor cells. As used herein, the term "tumor specific antigen (TSA)" means an antigenic substance produced in tumor cells, which can trigger an anti-tumor immune response in a host organism. In one embodiment, a TSA may be a tumor neoantigen. The tumor antigen specific antibody mediates complement-dependent cytotoxic response against tumor cells expressing the same antigen.

Of particular interest is a TSA that is a breast cancer antigen, an ovarian cancer antigen, a prostate cancer antigen, a cervical cancer antigen, a pancreatic carcinoma antigen, a lung cancer antigen, a bladder cancer antigen, a colon cancer antigen, a testicular cancer antigen, a glioblastoma cancer antigen, an antigen associated with a B cell malignancy, an antigen associated with multiple myeloma, an antigen associated with non-Hodgkins lymphoma, or an antigen associated with chronic lymphocytic leukemia.

Suitable antibodies which can immunoactively bind to a TSA may include, but are not limited to, those specific to 5T4, 707-AP, A33, AFP (α-fetoprotein), AKAP-4 (A kinase anchor protein 4), ALK, α5β1-integrin, androgen receptor, annexin II, alpha-actinin-4, ART-4, B1, B7H3, B7H4, BAGE (B melanoma antigen), BCMA, BCR-ABL fusion protein, beta-catenin, BKT-antigen, BTAA, CA-I (carbonic anhydrase I), CA50 (cancer antigen 50), CA125, CA15-3, CA195, CA242, calretinin, CAIX (carbonic anhydrase), CAMEL (cytotoxic T-lymphocyte recognized antigen on melanoma), CAM43, CAP-1, Caspase-8/m, CD4, CD5, CD7, CD19, CD20, CD22, CD23, CD25, CD27/m, CD28, CD30, CD33, CD34, CD36, CD38, CD40/CD154, CD41, CD44v6, CD44v7/8, CD45, CD49f, CD56, CD68KP1, CD74, CD79a/CD79b, CD103, CD123, CD133, CD138, CD171, cdc27/m, CDK4 (cyclin dependent kinase 4), CDKN2A, CDS, CEA (carcinoembryonic antigen), CEACAM5, CEACAM6, chromogranin, c-Met, c-Myc, coa-1, CSAp, CT7, CT10, cyclophilin B, cyclin B1, cytoplasmic tyrosine kinases, cytokeratin, DAM-10, DAM-6, dek-can fusion protein, desmin, DEPDC1 (DEP domain containing 1), E2A-PRL, EBNA, EGF-R (epidermal growth factor receptor), EGP-1 (epithelial glycoprotein-1) (TROP-2), EGP-2, EGP-40, EGFR (epidermal growth factor receptor), EGFRvIII, EF-2, ELF2M, EMMPRIN, EpCAM (epithelial cell adhesion molecule), EphA2, Epstein Barr virus antigens, Erb (ErbB 1; ErbB3; ErbB4), ETA (epithelial tumor antigen), ETV6-AML1 fusion protein, FAP (fibroblast activation protein), FBP (folate-binding protein), FGF-5, folate receptor α, FOS related antigen 1, fucosyl GM1, G250, GAGE (GAGE-1; GAGE-2), galactin, GD2 (ganglioside), GD3, GFAP (glial fibrillary acidic protein), GM2 (oncofetal antigen-immunogenic-1; OFA-I-1), GnT-V, Gp100, H4-RET, HAGE (helicase antigen), HER-2/neu, HIFs (hypoxia inducible factors), HIF-1α, HIF-2α, HLA-A2, HLA-A*0201-R170I, HLA-A11, HMWMAA, Hom/Mel-40, HSP70-2M (Heat shock protien 70), HST-2, HTgp-175, hTERT (or hTRT), human papillomavirus-E6/human papillomavirus-E7 and E6, iCE (immune-capture EIA), IGF-1R, IGH-IGK, IL2R, IL5, ILK (integrin-linked kinase), IMP3 (insulin-like growth factor II mRNA-binding protein 3), IRF4 (interferon regulatory factor 4), KDR (kinase insert domain receptor), KIAA0205, KRAB-zinc finger protein (KID)-3; KID31, KSA (17-1A), K-ras, LAGE, LCK, LDLR/FUT (LDLR-fucosyltransferaseAS fusion protein), LeY (Lewis Y), MAD-CT-1, MAGE (tyrosinase, melanoma-associated antigen) (MAGE-1; MAGE-3), melan-A tumor antigen (MART), MART-2/Ski, MC1R (melanocortin 1 receptor), MDM2, mesothelin, MPHOSPH1, MSA (muscle-specific actin), mTOR (mammalian targets of rapamycin), MUC-1, MUC-2, MUM-1 (melanoma associated antigen (mutated) 1), MUM-2, MUM-3, Myosin/m, MYL-RAR, NA88-A, N-acetylglucosaminyltransferase, neo-PAP, NF-KB (nuclear factor-kappa B), neurofilament, NSE (neuron-specific enolase), Notch receptors, NuMa, N-Ras, NY-BR-1, NY-CO-1, NY-ESO-1, Oncostatin M, OS-9, OY-TES1, p53 mutants, p190 minor bcr-abl, pl5(58), pl85erbB2, pl80erbB-3, PAGE (prostate associated gene), PAP (prostatic acid phosphatase), PAX3, PAX5, PDGFR (platelet derived growth factor receptor), cytochrome P450 involved in piperidine and pyrrolidine utilization (PIPA), Pml-RAR alpha fusion protein, PR-3 (proteinase 3), PSA (prostate specific antigen), PSM, PSMA (Prostate stem cell antigen), PRAME (preferentially expressed antigen of melanoma), PTPRK, RAGE (renal tumor antigen), Raf (A-Raf, B-Raf and C-Raf), Ras, receptor tyrosine kinases, RCAS 1, RGSS, ROR1 (receptor tyrosine kinase-like orphan receptor 1), RU1, RU2, SAGE, SART-1, SART-3, SCP-1, SDCCAGi6, SP-17 (sperm protein 17), src-family, SSX (synovial sarcoma X breakpoint)-1, SSX-2(HOM-MEL-40), SSX-3, SSX-4, SSX-5, STAT-3, STAT-5, STAT-6, STEAD, STn, survivin, syk-ZAP70, TA-90 (Mac-2 binding proteincyclophilin C-associated protein), TAAL6, TACSTD1 (tumor associated calcium signal transducer 1), TACSTD2, TAG-72-4, TAGE, TARP (T cell receptor gamma alternate reading frame protein), TEL/AML1 fusion protein, TEM1, TEM8 (endosialin or CD248), TGFβ, TIE2, TLP, TMPRSS2 ETS fusion gene, TNF-receptor (TNF-α receptor, TNF-β receptor; or TNF-γ receptor), transferrin receptor, TPS, TRP-1 (tyrosine related protein 1), TRP-2, TRP-2/INT2, TSP-180, VEGF receptor, WNT, WT-1 (Wilm's tumor antigen) and XAGE.

In one embodiment, the payload of the present invention may be an anti-CD47 antibody. CD47 is a ubiquitously expressed immunoregulatory protein that prevents phagocytic removal of healthy cells by the immune system. CD47 is expressed on the surface of many types of cancer cells, thereby disrupting anti-cancer immune responses. CD 47 is also involved in various other important cellular processes, such as angiogenesis, cancer cell death and regulation of T-cell immunity. Anti-CD47 antibodies in several pre-clinical studies have shown therapeutic benefit in solid cancers and most notably B-cell malignancies.

In one embodiment, the payload of the present invention may be an anti-CD22 antibody. As a non-limiting example, the anti-CD22 antibody is any of the antibodies, fragments or variants thereof described in US Patent Publication No. US20150086562. The anti-CD22 antibody may comprise a heavy chain variable region having the amino acid sequences of SEQ ID NO: 49-64 in US20150086562, and/or a light chain variable region having the amino acid sequence of SEQ ID NO: 17-32 in US20150086562; the contents of which are incorporated herein by reference in their entirety.

In some embodiments, payloads of the present invention may be antibodies, fragments and variants thereof which can specifically block an immunoinhibitory signal. These blocking antibodies (also referred to as antagonists) bind to co-inhibitory receptors, therefore blocking their signal transduction. As non-limiting examples, the blocking antibodies may be specific to CTLA-4, PD-1, and PD-L1/L2. In one embodiment, the anti-CTLA-4 antibody is Ipilimumab. In another embodiment, the anti-PD-1 antibody is Nivolumab. Antibodies that bind to PD-L1 and enhance T cell immune response may include antibodies taught in US patent publication NO.: 2016/0108123; the contents of which are incorporated by reference herein in their entirety. Other inhibitory immunomodulatory targets may include B7-H3, which can increase cancer cell metabolism such as glucose uptakes and lactate production (Lim et al., *Cancer Res.*, 2016, 76(8): 1-12). Antibodies that block B7-H3 are disclosed in U.S. Pat. No. 9,150,656; the contents of which are incorporated by reference herein in their entirety.

In one aspect, payloads of the present invention may be antagonistic antibodies specific to VSIG8 (v-set and immunoglobulin domain containing 8) comprising the amino acid sequences of SEQ ID NOs: 1, 2 and 3 in US patent publication NO.: US2016/0159927; the contents of which are incorporated by reference herein in their entirety. Antagonistic antibodies may also include a chimeric IL2 receptor (CD25) antibody (Basiliximab) (US Patent Publication NO.: 20080171017; the contents of which are incorporated herein by reference in their entirety), and antagonizing antibodies which bind to human TIM-3 (US patent publication NO.: US2015/0218274; the contents of which are incorporated herein by reference in their entirety), BTLA, VISTA and LAG-3 (See, e.g., US patent publication NO.: US2015/0259420; the contents of which are incorporated herein by reference in their entirety).

In one aspect, the payload of the present invention may be an anti-CSF-IR antibody, which is characterized in binding to the dimerization domains D4 to D5 of the extracellular domain of human CSF-IR. This antibody inhibitor can inhibit cell proliferation and survival in CSF-IR ligand-dependent and CSF-1 ligand-independent CSF-IR expressing tumor cells, monocytes and infiltrating macrophages (See, e.g., International Patent Publication NO.: WO2013/132044; the contents of which are incorporated herein by reference in their entirety).

In another aspect, the payload of the present invention may be an antagonistic antibody against CXCL12. The anti-CXCL12 antibody blocks the interaction of CXCL12 with its receptor CXCR4, thereby inhibiting CXCR4 signaling. The CXCR4 signaling inhibitor increases the proximity or the frequency of T-cells among cancer cells in the tumor tissue (See, International Patent Publication NO.: WO 2015/019284; the contents of which are incorporated by reference herein in their entirety).

In some embodiments, payloads of the present invention may be agonistic antibodies, fragments and variants thereof, which trigger immune responses, including antibodies specific to co-stimulatory molecules, including but not limited to 4-1BB (CD137), OX40 (CD134), CD40, GITR and CD27.

In one embodiment, the payload of the present invention may be an agonistic CD40 antibody. In another embodiment, the agonistic antibody specific to 4-1BB (CD137) may be Uremab, a fully human IgG4 monoclonal antibody which specifically binds to and activates 4-1BB (CD137) expressing immune cells, stimulating an immune response, in particular a cytotoxic T cell response, against tumor cells; or Utomilumab, a fully human IgG2 monoclonal antibody; or anti-CD137 antibody described in International Patent Publication NO.: WO2006/088447; the contents of which are incorporated herein by reference in their entirety.

In some embodiments, the payload of the present invention may be an antagonistic antibody against Amphiregulin. Amphiregulin (AREG) is an EGF-like growth factor which binds to the EGFR receptor and enhances T regulatory cell function. AREG is produced in a phenotypically and functionally distinct subtype of CD4$^+$ regulatory T cells (Tregs) which have a distinct T cell receptor (TCR) repertoire and express the IL33R. AREG promotes immune suppression in the tumor environment. The anti-Amphiregulin antibody may comprise a heavy chain variable region having the amino acid sequences of SEQ ID NO.: 2,4, and 12 in U.S. Pat. No. 7,223,393, and/or a light chain variable region having the amino acid sequence of SEQ ID NO.: 3, 5, and 14 in U.S. Pat. No. 7,223,393; the contents of which are incorporated herein by reference in their entirety.

In some embodiments, antibodies specific to co-inhibitory molecules and co-stimulatory molecules may be secreted scFv antibodies.

In some embodiments, antibody payloads of the present invention may be T-cell bispecific antibodies (e.g. T cell-engaging BiTE™ antibodies CDS-CD 19, CD3-EpCam, and CD3-EGFR). Other bispecific antibodies used for immunotherapy may also be included as payloads of the present invention, for example, bispecific anti-TNF-α and anti-IL6 antibody (EP3062818), bispecific antibodies to an immune cell antigen and TAG-72 (WO2016/089610), anti-ovarian and D3 bispecific antibodies in U.S. Pat. No. 7,262,276; bispecific antibodies against CD133 and CD3 in WO2014/128185; bispecific antibodies against CTLA-4 and PD-1 discussed in US2016/0145355, bispecific antibodies against CD3 and CD19 disclosed in WO2015/006749, and U.S. Pat. Nos. 7,635,472; 7,112,324; bispecific antibodies against Her2 and CD3 in US2014/0170149; bispecific antibodies against CD19 and CD16 in US2005/0089519; the contents of each of which are incorporated by reference herein in their entirety.

In some embodiments, antibodies with decreased affinity may be selected over antibodies with high affinity for the same antigen. Such low affinity antibodies are more effective in discriminating tumors which express high levels of the antigen and normal tissues that express the same antigen at lower levels, while maintaining similar antitumor response.

In some embodiments, the targeting moieties of the present invention may include variable heavy chain and variable light chain comprising the amino acid sequences selected from those in Table 10.

TABLE 10

Variable Heavy and Light Chain Sequences

| Target | Antibody chain | SEQ ID NO | Source |
|---|---|---|---|
| 5T4 | VH | 539 | SEQ ID NO. 2 in WO2016022939 |
| 5T4 | VH | 540 | SEQ ID NO. 4 in WO2016022939 |
| AGR2 | VH | 541 | SEQ ID NO. 10 in WO2016040321 |
| AGR2 | VH | 542 | SEQ ID NO. 18 in WO2016040321 |
| ALK | VH | 543 | SEQ ID NO. 11 in WO2015069922 |
| ALK | VH | 544 | SEQ ID NO. 13 in WO2015069922 |
| ALK | VH | 545 | SEQ ID NO. 15 in WO2015069922 |
| ALK | VH | 546 | SEQ ID NO. 7 in WO2015069922 |
| ALK | VH | 547 | SEQ ID NO. 9 in WO2015069922 |
| ALK | VH | 548 | SEQ ID NO: 1 in US20160280798A1 |
| ALK | VH | 549 | SEQ ID NO: 11 in US20160280798A1 |
| ALK | VH | 550 | SEQ ID NO: 13 in US20160280798A1 |
| ALK | VH | 551 | SEQ ID NO: 15 in US20160280798A1 |
| ALK | VH | 552 | SEQ ID NO: 3 in US20160280798A1 |
| ALK | VH | 553 | SEQ ID NO: 5 in US20160280798A1 |
| ALK | VH | 554 | SEQ ID NO: 7 in US20160280798A1 |
| ALK | VH | 555 | SEQ ID NO: 9 in US20160280798A1 |
| ALK | VH | 556 | SEQ ID NO. 1 in WO2015069922 |
| ALK | VH | 557 | SEQ ID NO. 3 in WO2015069922 |
| ALK | VH | 558 | SEQ ID NO. 5 in WO2015069922 |
| AMC | VH | 559 | SEQ ID NO. 17 in WO2016161390 |
| AMC | VH | 560 | SEQ ID NO. 18 in WO2016161390 |
| AMC | VH | 561 | SEQ ID NO. 19 in WO2016161390 |
| AMC | VH | 562 | SEQ ID NO. 20 in WO2016161390 |
| AMC | VH | 563 | SEQ ID NO. 21 in WO2016161390 |
| AMC | VH | 564 | SEQ ID NO. 22 in WO2016161390 |
| AMC | VH | 565 | SEQ ID NO. 23 in WO2016161390 |
| AMC | VH | 566 | SEQ ID NO. 24 in WO2016161390 |
| AMC | VH | 567 | SEQ ID NO. 25 in WO2016161390 |
| AMC | VH | 568 | SEQ ID NO. 26 in WO2016161390 |
| ANG2 | VH | 569 | SEQ ID NO. 1 in WO2015091655 |
| ANG2 | VH | 570 | SEQ ID NO. 3 in WO2015091655 |
| APCDD1 | VH | 571 | SEQ ID NO: 10 in WO2012019061 |
| APCDD1 | VH | 572 | SEQ ID NO: 102 in WO2012019061 |
| APCDD1 | VH | 573 | SEQ ID NO: 106 in WO2012019061 |
| APCDD1 | VH | 574 | SEQ ID NO: 110 in WO2012019061 |
| APCDD1 | VH | 575 | SEQ ID NO: 114 in WO2012019061 |
| APCDD1 | VH | 576 | SEQ ID NO: 118 in WO2012019061 |
| APCDD1 | VH | 577 | SEQ ID NO: 122 in WO2012019061 |
| APCDD1 | VH | 578 | SEQ ID NO: 126 in WO2012019061 |
| APCDD1 | VH | 579 | SEQ ID NO: 130 in WO2012019061 |
| APCDD1 | VH | 580 | SEQ ID NO: 134 in WO2012019061 |
| APCDD1 | VH | 581 | SEQ ID NO: 14 in WO2012019061 |
| APCDD1 | VH | 582 | SEQ ID NO: 6 in WO2012019061 |
| APCDD1 | VH | 583 | SEQ ID NO: 98 in WO2012019061 |
| APRIL | VH | 584 | SEQ ID NO. 12 in US20160264674 |
| APRIL | VH | 585 | SEQ ID NO. 14 in US20160264674 |
| APRIL | VH | 586 | SEQ ID NO. 16 in US20160264674 |
| APRIL | VH | 587 | SEQ ID NO. 18 in US20160264674 |
| APRIL | VH | 588 | SEQ ID NO. 3 in US20160264674 |
| APRIL | VH | 589 | SEQ ID NO. 32 in US20160264674 |
| APRIL | VH | 590 | SEQ ID NO. 34 in US20160264674 |
| APRIL | VH | 591 | SEQ ID NO. 36 in US20160264674 |
| APRIL | VH | 592 | SEQ ID NO. 38 in US20160264674 |
| APRIL | VH | 593 | SEQ ID NO. 40 in US20160264674 |
| APRIL | VH | 594 | SEQ ID NO. 42 in US20160264674 |
| APRIL | VH | 595 | SEQ ID NO. 44 in US20160264674 |
| APRIL | VH | 596 | SEQ ID NO. 46 in US20160264674 |
| APRIL | VH | 597 | SEQ ID NO. 48 in US20160264674 |
| APRIL | VH | 598 | SEQ ID NO. 52 in US20160264674 |
| AXL | VH | 599 | SEQ ID NO. 21 in WO2016097370 |
| AXL | VH | 600 | SEQ ID NO. 3 in WO2016097370 |
| AXL | VH | 601 | SEQ ID NO. 45 in WO2016097370 |
| B2MG | VH | 602 | SEQIDNO: 28 in WO2016126213A1 |
| B7H1 | VH | 603 | SEQ ID NO: 12 in US20130034559 |
| B7H1 | VH | 604 | SEQ ID NO: 32 in US20130034559 |
| B7H1 | VH | 605 | SEQ ID NO: 42 in US20130034559 |

TABLE 10-continued

Variable Heavy and Light Chain Sequences

| Target | Antibody chain | SEQ ID NO | Source |
|---|---|---|---|
| B7H1 | VH | 606 | SEQ ID NO: 52 in US20130034559 |
| B7H1 | VH | 607 | SEQ ID NO: 72 in US20130034559 |
| B7H1 | VH | 608 | SEQ ID NO: 2 in US20130034559 |
| B7H1 | VH | 609 | SEQ ID NO: 62 in US20130034559 |
| B7H3 | VH | 610 | SEQ ID NO. 10 in WO2016033225 |
| B7H3 | VH | 611 | SEQ ID NO. 11 in WO2016033225 |
| B7H3 | VH | 612 | SEQ ID NO. 12 in WO2016033225 |
| B7H3 | VH | 613 | SEQ ID NO. 13 in WO2016033225 |
| B7H3 | VH | 614 | SEQ ID NO. 14 in WO2016033225 |
| B7H3 | VH | 615 | SEQ ID NO. 15 in WO2016033225 |
| B7H3 | VH | 616 | SEQ ID NO. 16 in WO2016033225 |
| B7H3 | VH | 617 | SEQ ID NO. 9 in WO2016033225 |
| B7H3(CD276) | VH | 618 | SEQ ID NO. 17 in WO2016044383 |
| B7H3(CD276) | VH | 619 | SEQ ID NO. 26 in WO2016044383 |
| B7H3(CD276) | VH | 620 | SEQ ID NO. 7 in WO2016044383 |
| B7H4 | VH | 621 | SEQ ID NO. 100 in US20160159910 |
| B7H4 | VH | 622 | SEQ ID NO. 101 in US20160159910 |
| B7H4 | VH | 623 | SEQ ID NO. 102 in US20160159910 |
| B7H4 | VH | 624 | SEQ ID NO. 103 in US20160159910 |
| B7H4 | VH | 625 | SEQ ID NO. 107 in US20160159910 |
| B7H4 | VH | 626 | SEQ ID NO. 108 in US20160159910 |
| B7H4 | VH | 627 | SEQ ID NO. 109 in US20160159910 |
| B7H4 | VH | 628 | SEQ ID NO. 110 in US20160159910 |
| B7H4 | VH | 629 | SEQ ID NO. 111 in US20160159910 |
| B7H4 | VH | 630 | SEQ ID NO. 112 in US20160159910 |
| B7H4 | VH | 631 | SEQ ID NO. 113 in US20160159910 |
| B7H4 | VH | 632 | SEQ ID NO. 114 in US20160159910 |
| B7H4 | VH | 633 | SEQ ID NO. 12 in US20160159910 |
| B7H4 | VH | 634 | SEQ ID NO. 127 in US20160159910 |
| B7H4 | VH | 635 | SEQ ID NO. 13 in WO2016160620 |
| B7H4 | VH | 636 | SEQ ID NO. 130 in US20160159910 |
| B7H4 | VH | 637 | SEQ ID NO. 131 in US20160159910 |
| B7H4 | VH | 638 | SEQ ID NO. 132 in US20160159910 |
| B7H4 | VH | 639 | SEQ ID NO. 133 in US20160159910 |
| B7H4 | VH | 640 | SEQ ID NO. 137 in US20160159910 |
| B7H4 | VH | 641 | SEQ ID NO. 2 in US20160159910 |
| B7H4 | VH | 642 | SEQ ID NO. 20 in US20160159910 |
| B7H4 | VH | 643 | SEQ ID NO. 28 in US20160159910 |
| B7H4 | VH | 644 | SEQ ID NO. 36 in US20160159910 |
| B7H4 | VH | 645 | SEQ ID NO. 37 in US20160159910 |
| B7H4 | VH | 646 | SEQ ID NO. 38 in US20160159910 |
| B7H4 | VH | 647 | SEQ ID NO. 4 in US20160159910 |
| B7H4 | VH | 648 | SEQ ID NO. 56 in US20160159910 |
| B7H4 | VH | 649 | SEQ ID NO. 99 in US20160159910 |
| B7H4 | VH | 650 | SEQ ID NO. 144 in US20160159910 |
| B7H4 | VH | 651 | SEQ ID NO. 15 in WO2016160620 |
| B7H4 | VH | 652 | SEQ ID NO. 17 in WO2016160620 |
| BAT1 | VH | 653 | SEQ ID NO. 5 in WO2013014668 |
| BAT1 | VH | 654 | SEQ ID NO. 6 in WO2013014668 |
| BAT1 | VH | 655 | SEQ ID NO. 7 in WO2013014668 |
| BAT1 | VH | 656 | SEQ ID NO. 8 in WO2013014668 |
| BAT1 | VH | 657 | SEQ ID NO. 9 in WO2013014668 |
| BCMA | VH | 658 | SEQ ID NO: 26 in WO2016168773A3 |
| BCMA | VH | 659 | SEQ ID NO: 142 in WO2016168595A1 |
| BCMA | VH | 660 | SEQ ID NO: 148 in WO2016168595A1 |
| BCMA | VH | 661 | SEQ ID NO: 154 in WO2016168595A1 |
| BCMA | VH | 662 | SEQ ID NO: 160 in WO2016168595A1 |
| BCMA | VH | 663 | SEQ ID NO: 166 in WO2016168595A1 |
| BCMA | VH | 664 | SEQ ID NO: 172 in WO2016168595A1 |
| BCMA | VH | 665 | SEQ ID NO: 178 in WO2016168595A1 |
| BCMA | VH | 666 | SEQ ID NO: 184 in WO2016168595A1 |
| BCMA | VH | 667 | SEQ ID NO: 190 in WO2016168595A1 |
| BCMA | VH | 668 | SEQ ID NO: 196 in WO2016168595A1 |
| BCMA | VH | 669 | SEQ ID NO: 202 in WO2016168595A1 |
| BCMA | VH | 670 | SEQ ID NO: 208 in WO2016168595A1 |
| BCMA | VH | 671 | SEQ ID NO: 214 in WO2016168595A1 |
| BCMA | VH | 672 | SEQ ID NO: 220 in WO2016168595A1 |
| BCMA | VH | 673 | SEQ ID NO: 226 in WO2016168595A1 |
| BCMA | VH | 674 | SEQ ID NO: 232 in WO2016168595A1 |
| BCMA | VH | 675 | SEQ ID NO: 238 in WO2016168595A1 |
| BCMA | VH | 676 | SEQ ID NO: 244 in WO2016168595A1 |
| BCMA | VH | 677 | SEQ ID NO: 250 in WO2016168595A1 |
| BCMA | VH | 678 | SEQ ID NO: 256 in WO2016168595A1 |
| BCMA | VH | 679 | SEQ ID NO: 262 in WO2016168595A1 |
| BCMA | VH | 680 | SEQ ID NO: 268 in WO2016168595A1 |

TABLE 10-continued

Variable Heavy and Light Chain Sequences

| Target | Antibody chain | SEQ ID NO | Source |
|---|---|---|---|
| BCMA | VH | 681 | SEQ ID NO: 274 in WO2016168595A1 |
| BCMA | VH | 682 | SEQ ID NO: 280 in WO2016168595A1 |
| BCMA | VH | 683 | SEQ ID NO: 286 in WO2016168595A1 |
| BCMA | VH | 684 | SEQ ID NO: 292 in WO2016168595A1 |
| BCMA | VH | 685 | SEQ ID NO: 298 in WO2016168595A1 |
| BCMA | VH | 686 | SEQ ID NO: 304 in WO2016168595A1 |
| BCMA | VH | 687 | SEQ ID NO: 310 in WO2016168595A1 |
| BCMA | VH | 688 | SEQ ID NO: 316 in WO2016168595A1 |
| BCMA | VH | 689 | SEQ ID NO: 322 in WO2016168595A1 |
| BCMA | VH | 690 | SEQ ID NO: 328 in WO2016168595A1 |
| BCMA | VH | 691 | SEQ ID NO: 334 in WO2016168595A1 |
| BCMA | VH | 692 | SEQ ID NO: 340 in WO2016168595A1 |
| BCMA | VH | 693 | SEQ ID NO: 346 in WO2016168595A1 |
| BCMA | VH | 694 | SEQ ID NO: 352 in WO2016168595A1 |
| BCMA | VH | 695 | SEQ ID NO: 8 in WO2016094304A3 |
| BCMA | VH | 696 | SEQ ID NO. 171 WO2016014565 |
| BCMA | VH | 697 | SEQ ID NO. 172 WO2016014565 |
| BCMA | VH | 698 | SEQ ID NO. 173 WO2016014565 |
| BCMA | VH | 699 | SEQ ID NO. 174 WO2016014565 |
| BCMA | VH | 700 | SEQ ID NO. 175 WO2016014565 |
| BCMA | VH | 701 | SEQ ID NO. 176 WO2016014565 |
| BCMA | VH | 702 | SEQ ID NO. 177 WO2016014565 |
| BCMA | VH | 703 | SEQ ID NO. 178 WO2016014565 |
| BCMA | VH | 704 | SEQ ID NO. 179 WO2016014565 |
| BCMA | VH | 705 | SEQ ID NO. 180 WO2016014565 |
| BCMA | VH | 706 | SEQ ID NO. 181 WO2016014565 |
| BCMA | VH | 707 | SEQ ID NO. 182 WO2016014565 |
| BCMA | VH | 708 | SEQ ID NO. 183 WO2016014565 |
| BCMA | VH | 709 | SEQ ID NO. 184 WO2016014565 |
| BCMA | VH | 710 | SEQ ID NO. 185 WO2016014565 |
| BCMA | VH | 711 | SEQ ID NO. 186 WO2016014565 |
| BCMA | VH | 712 | SEQ ID NO. 187 WO2016014565 |
| BCMA | VH | 713 | SEQ ID NO. 190 WO2016014565 |
| BCMA | VH | 714 | SEQ ID NO. 255 WO2016014565 |
| BCMA | VH | 715 | SEQ ID NO. 257 WO2016014565 |
| BCMA | VH | 716 | SEQ ID NO. 258 WO2016014565 |
| BCMA | VH | 717 | SEQ ID NO. 69 WO2016014565 |
| BCMA | VH | 718 | SEQ ID NO. 70 WO2016014565 |
| BCMA | VH | 719 | SEQ ID NO. 71 WO2016014565 |
| BCMA | VH | 720 | SEQ ID NO. 72 WO2016014565 |
| BCMA | VH | 721 | SEQ ID NO. 73 WO2016014565 |
| BCMA | VH | 722 | SEQ ID NO. 74 WO2016014565 |
| BCMA | VH | 723 | SEQ ID NO. 75 WO2016014565 |
| BCMA | VH | 724 | SEQ ID NO. 76 WO2016014565 |
| BCMA | VH | 725 | SEQ ID NO. 77 WO2016014565 |
| BCMA | VH | 726 | SEQ ID NO. 78 WO2016014565 |
| BCMA | VH | 727 | SEQ ID NO. 79 WO2016014565 |
| BCMA | VH | 728 | SEQ ID NO. 80 WO2016014565 |
| BCMA | VH | 729 | SEQ ID NO. 81 WO2016014565 |
| BCMA | VH | 730 | SEQ ID NO: 38 in EP3057994A1 |
| BCMA | VH | 731 | SEQ ID NO: 55 in WO2016187349A1 |
| BCMA | VH | 732 | SEQ ID NO. 1 in WO2016090320 |
| BCMA | VH | 733 | SEQ ID NO. 10 in WO2016014789 |
| BCMA | VH | 734 | SEQ ID NO. 101 in WO2016120216 |
| BCMA | VH | 735 | SEQ ID NO. 11 in WO2015158671A1 |
| BCMA | VH | 736 | SEQ ID NO. 11 in WO2016014789 |
| BCMA | VH | 737 | SEQ ID NO. 12 in WO2016014789 |
| BCMA | VH | 738 | SEQ ID NO. 13 in WO2016014789 |
| BCMA | VH | 739 | SEQ ID NO. 13 in WO2016090320 |
| BCMA | VH | 740 | SEQ ID NO. 14 in WO2016014789 |
| BCMA | VH | 741 | SEQ ID NO. 17 in WO2015158671A1 |
| BCMA | VH | 742 | SEQ ID NO. 17 in WO2016090320 |
| BCMA | VH | 743 | SEQ ID NO. 174 in WO2016120216 |
| BCMA | VH | 744 | SEQ ID NO. 21 in WO2016090320 |
| BCMA | VH | 745 | SEQ ID NO. 25 in WO2016090320 |
| BCMA | VH | 746 | SEQ ID NO. 29 in WO2016090320 |
| BCMA | VH | 747 | SEQ ID NO. 33 in WO2016090320 |
| BCMA | VH | 748 | SEQ ID NO. 37 in WO2016090320 |
| BCMA | VH | 749 | SEQ ID NO. 41 in WO2016090320 |
| BCMA | VH | 750 | SEQ ID NO. 45 in WO2016090320 |
| BCMA | VH | 751 | SEQ ID NO. 49 in WO2016090320 |
| BCMA | VH | 752 | SEQ ID NO. 5 in WO2016090320 |
| BCMA | VH | 753 | SEQ ID NO. 53 in WO2016090320 |
| BCMA | VH | 754 | SEQ ID NO. 57 in WO2016090320 |
| BCMA | VH | 755 | SEQ ID NO. 61 in WO2016090320 |

TABLE 10-continued

Variable Heavy and Light Chain Sequences

| Target | Antibody chain | SEQ ID NO | Source |
|---|---|---|---|
| BCMA | VH | 756 | SEQ ID NO. 65 in WO2016090320 |
| BCMA | VH | 757 | SEQ ID NO. 9 in WO2016090320 |
| BCMA | VH | 758 | SEQ ID NO. 95 in WO2016120216 |
| BCMA | VH | 759 | SEQ ID NO. 97 in WO2016120216 |
| BCMA | VH | 760 | SEQ ID NO. 99 in WO2016120216 |
| BCMA | VH | 761 | SEQ ID NO: 15 in WO2016168766A1 |
| BMPR1A | VH | 762 | SEQ ID NO. 12 in WO2011116212 |
| CA19.9 | VH | 763 | SEQ ID NO: 117 in US20160333114A1 |
| Campath1 | VH | 764 | SEQ ID NO: 34 in US20160333114A1 |
| CD105 | VH | 765 | SEQ ID NO. 13 in WO2014039682 |
| CD105 | VH | 766 | SEQ ID NO. 14 in WO2014039682 |
| CD105 | VH | 767 | SEQ ID NO. 16 in WO2014039682 |
| CD123 | VH | 768 | SEQ ID NO. 11 in WO2015140268A1 |
| CD123 | VH | 769 | SEQ ID NO. 113 in WO2016120216 |
| CD123 | VH | 770 | SEQ ID NO. 115 in WO2016120216 |
| CD123 | VH | 771 | SEQ ID NO. 12 in WO2016120220 |
| CD123 | VH | 772 | SEQ ID NO. 13 in WO2015140268A1 |
| CD123 | VH | 773 | SEQ ID NO. 14 in WO2015140268A1 |
| CD123 | VH | 774 | SEQ ID NO. 21 in WO2015140268A1 |
| CD123 | VH | 775 | SEQ ID NO. 24 in WO2016120220 |
| CD123 | VH | 776 | SEQ ID NO. 25 in WO2016120220 |
| CD123 | VH | 777 | SEQ ID NO. 26 in WO2016120220 |
| CD123 | VH | 778 | SEQ ID NO. 27 in WO2016120220 |
| CD123 | VH | 779 | SEQ ID NO. 28 in WO2016120220 |
| CD123 | VH | 780 | SEQ ID NO. 29 in WO2016120220 |
| CD123 | VH | 781 | SEQ ID NO. 30 in WO2016120220 |
| CD123 | VH | 782 | SEQ ID NO. 57 in WO2016120216 |
| CD123 | VH | 783 | SEQ ID NO. 59 in WO2016120216 |
| CD123 | VH | 784 | SEQ ID NO. 63 in WO2016120216 |
| CD123 | VH | 785 | SEQ ID NO: 216 in WO2016028896 |
| CD123 | VH | 786 | SEQ ID NO: 217 in WO2016028896 |
| CD123 | VH | 787 | SEQ ID NO: 218 in WO2016028896 |
| CD123 | VH | 788 | SEQ ID NO: 219 in WO2016028896 |
| CD123 | VH | 789 | SEQ ID NO: 274 in WO2016028896 |
| CD123 | VH | 790 | SEQ ID NO: 9 in WO2016120220 |
| CD123 | VH | 791 | SEQ ID NO: 9 in WO2016120220 |
| CD123 | VH | 792 | SEQ ID NO: 9 in WO2016120220 |
| CD123 | VH | 793 | SEQ ID NO: 9 in WO2016120220 |
| CD148 | VH | 794 | SEQ ID NO 10 in WO2005118643 |
| CD148 | VH | 795 | SEQ ID NO 14 in WO2005118643 |
| CD148 | VH | 796 | SEQ ID NO 18 in WO2005118643 |
| CD148 | VH | 797 | SEQ ID NO 2 in WO2005118643 |
| CD148 | VH | 798 | SEQ ID NO 22 in WO2005118643 |
| CD148 | VH | 799 | SEQ ID NO 26 in WO2005118643 |
| CD148 | VH | 800 | SEQ ID NO 30 in WO2005118643 |
| CD148 | VH | 801 | SEQ ID NO 6 in WO2005118643 |
| CD16 | VH | 802 | SEQ ID NO. 25 in WO2015158868 |
| CD19 | VH | 803 | SEQ ID NO: 28 in WO2016168773A3 |
| CD19 | VH | 804 | SEQ ID NO: 29 in WO2016168773A3 |
| CD19 | VH | 805 | SEQ ID NO: 32 in WO2016168773A3 |
| CD19 | VH | 806 | SEQ ID NO: 33 in WO2016168773A3 |
| CD19 | VH | 807 | SEQ ID NO: 34 in WO2016168773A3 |
| CD19 | VH | 808 | SEQ ID NO: 35 in WO2016168773A3 |
| CD19 | VH | 809 | SEQ ID NO: 51 in WO2016187349A1 |
| CD19 | VH | 810 | SEQ ID NO: 20 in US20160039942 |
| CD19 | VH | 811 | SEQ ID NO. 1 in WO2014184143 |
| CD19 | VH | 812 | SEQ ID NO. 5 in US20160145337A1 |
| CD19 | VH | 813 | SEQ ID NO: 15 US20160319020 |
| CD19 | VH | 814 | SEQ ID NO: 166 US20160152723 |
| CD19 | VH | 815 | SEQ ID NO: 167 US20160152723 |
| CD19 | VH | 816 | SEQ ID NO: 168 US20160152723 |
| CD19 | VH | 817 | SEQ ID NO: 17 in EP3057991A1 |
| CD19 | VH | 818 | SEQ ID NO: 172 US20160152723 |
| CD19 | VH | 819 | SEQ ID NO: 176 US20160152723 |
| CD19 | VH | 820 | SEQ ID NO: 177 US20160152723 |
| CD19 | VH | 821 | SEQ ID NO: 181 US20160152723 |
| CD19 | VH | 822 | SEQ ID NO: 183 US20160152723 |
| CD19 | VH | 823 | SEQ ID NO: 184 US20160152723 |
| CD19 | VH | 824 | SEQ ID NO: 185 US20160152723 |
| CD19 | VH | 825 | SEQ ID NO: 62 US20160152723 |
| CD19 | VH | 826 | SEQ ID NO: 62 in WO2016097231 |
| CD19 | VH | 827 | SEQ ID NO. 12 in WO2016134284 |
| CD19 | VH | 828 | SEQ ID NO: 111 in US20160333114A1 |
| CD19 | VH | 829 | SEQ ID NO: 113 in US20160333114A1 |
| CD19 | VH | 830 | SEQ ID NO: 33 in EP3057994A1 |

TABLE 10-continued

Variable Heavy and Light Chain Sequences

| Target | Antibody chain | SEQ ID NO | Source |
|---|---|---|---|
| CD19 | VH | 831 | SEQ ID NO: 34 in EP3057994A1 |
| CD19 | VH | 832 | SEQ ID NO: 35 in EP3057994A1 |
| CD2 | VH | 833 | SEQ ID NO. 103 in WO2016122701 |
| CD2 | VH | 834 | SEQ ID NO. 117 in WO2016122701 |
| CD2 | VH | 835 | SEQ ID NO. 119 in WO2016122701 |
| CD20 | VH | 836 | SEQ ID NO: 45 in WO2016097231 |
| CD20 | VH | 837 | SEQ ID NO. 11 in WO2017004091 |
| CD20 | VH | 838 | SEQ ID NO. 13 in WO2017004091 |
| CD20 | VH | 839 | SEQ ID NO. 14 in WO2017004091 |
| CD20 | VH | 840 | SEQ ID NO. 15 in WO2017004091 |
| CD20 | VH | 841 | SEQ ID NO. 16 in WO2017004091 |
| CD20 | VH | 842 | SEQ ID NO. 17 in WO2017004091 |
| CD20 | VH | 843 | SEQ ID NO. 18 in WO2017004091 |
| CD20 | VH | 844 | SEQ ID NO. 19 in WO2017004091 |
| CD20 | VH | 845 | SEQ ID NO. 20 in WO2017004091 |
| CD20 | VH | 846 | SEQ ID NO. 21 in WO2017004091 |
| CD20 | VH | 847 | SEQ ID NO. 22 in WO2017004091 |
| CD20 | VH | 848 | SEQ ID NO. 23 in WO2017004091 |
| CD20 | VH | 849 | SEQ ID NO. 24 in WO2017004091 |
| CD20 | VH | 850 | SEQ ID NO. 25 in WO2017004091 |
| CD20 | VH | 851 | SEQ ID NO. 26 in WO2017004091 |
| CD20 | VH | 852 | SEQ ID NO. 27 in WO2017004091 |
| CD20 | VH | 853 | SEQ ID NO. 28 in WO2017004091 |
| CD20 | VH | 854 | SEQ ID NO. 29 in WO2017004091 |
| CD20 | VH | 855 | SEQ ID NO. 30 in WO2017004091 |
| CD20 | VH | 856 | SEQ ID NO. 31 in WO2017004091 |
| CD20 | VH | 857 | SEQ ID NO. 32 in WO2017004091 |
| CD20 | VH | 858 | SEQ ID NO. 33 in WO2017004091 |
| CD20 | VH | 859 | SEQ ID NO. 7 in WO2017004091 |
| CD20 | VH | 860 | SEQ ID NO. 9 in WO2017004091 |
| CD20(Ofatumumab) | VH | 861 | SEQ ID NO: 54 in US20160333114A1 |
| CD22 | VH | 862 | SEQ ID NO: 10 in US20150239974 |
| CD22 | VH | 863 | SEQ ID NO: 11 in US20150239974 |
| CD22 | VH | 864 | SEQ ID NO: 12 in US20150239974 |
| CD22 | VH | 865 | SEQ ID NO: 7 in US20150239974 |
| CD22 | VH | 866 | SEQ ID NO: 9 in US20150239974 |
| CD22 | VH | 867 | SEQ ID NO. 8 in US20150299317 |
| CD22 | VH | 868 | SEQ ID NO: 201 in WO2016164731A2 |
| CD22 | VH | 869 | SEQ ID NO: 671 in WO2016164731A41 |
| CD22 | VH | 870 | SEQ ID NO: 672 in WO2016164731A42 |
| CD22 | VH | 871 | SEQ ID NO: 673 in WO2016164731A43 |
| CD22 | VH | 872 | SEQ ID NO: 676 in WO2016164731A46 |
| CD22 | VH | 873 | SEQ ID NO: 678 in WO2016164731A48 |
| CD22 | VH | 874 | SEQ ID NO: 679 in WO2016164731A49 |
| CD22 | VH | 875 | SEQ ID NO: 680 in WO2016164731A50 |
| CD22 | VH | 876 | SEQ ID NO: 700 in WO2016164731A2 |
| CD22 | VH | 877 | SEQ ID NO: 701 in WO2016164731A3 |
| CD22 | VH | 878 | SEQ ID NO: 702 in WO2016164731A4 |
| CD22 | VH | 879 | SEQ ID NO: 703 in WO2016164731A5 |
| CD22 | VH | 880 | SEQ ID NO: 704 in WO2016164731A6 |
| CD22 | VH | 881 | SEQ ID NO: 705 in WO2016164731A7 |
| CD22 | VH | 882 | SEQ ID NO: 706 in WO2016164731A8 |
| CD22 | VH | 883 | SEQ ID NO: 707 in WO2016164731A9 |
| CD22 | VH | 884 | SEQ ID NO: 708 in WO2016164731A10 |
| CD22 | VH | 885 | SEQ ID NO: 709 in WO2016164731A11 |
| CD22 | VH | 886 | SEQ ID NO: 711 in WO2016164731A13 |
| CD22 | VH | 887 | SEQ ID NO: 712 in WO2016164731A14 |
| CD22 | VH | 888 | SEQ ID NO: 713 in WO2016164731A15 |
| CD22 | VH | 889 | SEQ ID NO: 714 in WO2016164731A16 |
| CD22 | VH | 890 | SEQ ID NO: 715 in WO2016164731A17 |
| CD22 | VH | 891 | SEQ ID NO: 716 in WO2016164731A18 |
| CD22 | VH | 892 | SEQ ID NO: 717 in WO2016164731A19 |
| CD22 | VH | 893 | SEQ ID NO: 718 in WO2016164731A20 |
| CD22 | VH | 894 | SEQ ID NO: 719 in WO2016164731A21 |
| CD22 | VH | 895 | SEQ ID NO: 720 in WO2016164731A22 |
| CD22 | VH | 896 | SEQ ID NO: 721 in WO2016164731A23 |
| CD22 | VH | 897 | SEQ ID NO: 722 in WO2016164731A24 |
| CD22 | VH | 898 | SEQ ID NO: 723 in WO2016164731A25 |
| CD22 | VH | 899 | SEQ ID NO: 724 in WO2016164731A26 |
| CD22 | VH | 900 | SEQ ID NO: 725 in WO2016164731A27 |
| CD22 | VH | 901 | SEQ ID NO: 726 in WO2016164731A28 |
| CD22 | VH | 902 | SEQ ID NO: 727 in WO2016164731A29 |
| CD22 | VH | 903 | SEQ ID NO: 728 in WO2016164731A30 |
| CD22 | VH | 904 | SEQ ID NO: 729 in WO2016164731A31 |
| CD22 | VH | 905 | SEQ ID NO: 730 in WO2016164731A32 |

TABLE 10-continued

Variable Heavy and Light Chain Sequences

| Target | Antibody chain | SEQ ID NO | Source |
|---|---|---|---|
| CD22 | VH | 906 | SEQ ID NO: 731 in WO2016164731A33 |
| CD22 | VH | 907 | SEQ ID NO: 732 in WO2016164731A34 |
| CD22 | VH | 908 | SEQ ID NO: 733 in WO2016164731A35 |
| CD22 | VH | 909 | SEQ ID NO: 734 in WO2016164731A36 |
| CD22 | VH | 910 | SEQ ID NO: 735 in WO2016164731A37 |
| CD22 | VH | 911 | SEQ ID NO: 736 in WO2016164731A38 |
| CD22 | VH | 912 | SEQ ID NO: 737 in WO2016164731A39 |
| CD22 | VH | 913 | SEQ ID NO: 738 in WO2016164731A40 |
| CD276 | VH | 914 | SEQ ID NO. 17 in US20160053017 |
| CD276 | VH | 915 | SEQ ID NO. 26 in US20160053017 |
| CD276 | VH | 916 | SEQ ID NO. 7 in US20160053017 |
| CD3 | VH | 917 | SEQ ID NO. 108 in WO2016122701 |
| CD3 | VH | 918 | SEQ ID NO. 112 in WO2016122701 |
| CD3 | VH | 919 | SEQ ID NO. 115 in WO2016122701 |
| CD3 | VH | 920 | SEQ ID NO: 29 in WO2014144722A2 |
| CD3 | VH | 921 | SEQIDNO: 12 in WO2016126213A1 |
| CD30 | VH | 922 | SEQ ID NO. 14 in WO2016134284 |
| CD30 | VH | 923 | SEQ ID NO. 16 in WO2016134284 |
| CD324 | VH | 924 | SEQ ID NO. 21 in U.S. Pat. No. 9,534,058 |
| CD324 | VH | 925 | SEQ ID NO. 23 in U.S. Pat. No. 9,534,058 |
| CD324 | VH | 926 | SEQ ID NO. 25 in U.S. Pat. No. 9,534,058 |
| CD324 | VH | 927 | SEQ ID NO. 27 in U.S. Pat. No. 9,534,058 |
| CD324 | VH | 928 | SEQ ID NO. 29 in U.S. Pat. No. 9,534,058 |
| CD324 | VH | 929 | SEQ ID NO. 31 in U.S. Pat. No. 9,534,058 |
| CD324 | VH | 930 | SEQ ID NO. 33 in U.S. Pat. No. 9,534,058 |
| CD324 | VH | 931 | SEQ ID NO. 35 in U.S. Pat. No. 9,534,058 |
| CD324 | VH | 932 | SEQ ID NO. 37 in U.S. Pat. No. 9,534,058 |
| CD324 | VH | 933 | SEQ ID NO. 39 in U.S. Pat. No. 9,534,058 |
| CD324 | VH | 934 | SEQ ID NO. 41 in U.S. Pat. No. 9,534,058 |
| CD324 | VH | 935 | SEQ ID NO. 43 in U.S. Pat. No. 9,534,058 |
| CD324 | VH | 936 | SEQ ID NO. 45 in U.S. Pat. No. 9,534,058 |
| CD324 | VH | 937 | SEQ ID NO. 47 in U.S. Pat. No. 9,534,058 |
| CD324 | VH | 938 | SEQ ID NO. 49 in U.S. Pat. No. 9,534,058 |
| CD324 | VH | 939 | SEQ ID NO. 51 in U.S. Pat. No. 9,534,058 |
| CD324 | VH | 940 | SEQ ID NO. 53 in U.S. Pat. No. 9,534,058 |
| CD324 | VH | 941 | SEQ ID NO. 55 in U.S. Pat. No. 9,534,058 |
| CD324 | VH | 942 | SEQ ID NO. 57 in U.S. Pat. No. 9,534,058 |
| CD324 | VH | 943 | SEQ ID NO. 59 in U.S. Pat. No. 9,534,058 |
| CD324 | VH | 944 | SEQ ID NO. 61 in U.S. Pat. No. 9,534,058 |
| CD324 | VH | 945 | SEQ ID NO. 63 in U.S. Pat. No. 9,534,058 |
| CD324 | VH | 946 | SEQ ID NO. 65 in U.S. Pat. No. 9,534,058 |
| CD324 | VH | 947 | SEQ ID NO. 67 in U.S. Pat. No. 9,534,058 |
| CD324 | VH | 948 | SEQ ID NO. 69 in U.S. Pat. No. 9,534,058 |
| CD324 | VH | 949 | SEQ ID NO. 71 in U.S. Pat. No. 9,534,058 |
| CD32B | VH | 950 | SEQ ID NO. 127 in WO2016122701 |
| CD33 | VH | 951 | SEQ ID NO. 11 in WO2015150526A2 |
| CD33 | VH | 952 | SEQ ID NO. 13 in WO2015150526A2 |
| CD33 | VH | 953 | SEQ ID NO. 15 in WO2015150526A2 |
| CD33 | VH | 954 | SEQ ID NO. 17 in WO2015150526A2 |
| CD33 | VH | 955 | SEQ ID NO. 57 in WO2016014576 |
| CD33 | VH | 956 | SEQ ID NO. 58 in WO2016014576 |
| CD33 | VH | 957 | SEQ ID NO. 59 in WO2016014576 |
| CD33 | VH | 958 | SEQ ID NO. 60 in WO2016014576 |
| CD33 | VH | 959 | SEQ ID NO. 61 in WO2016014576 |
| CD33 | VH | 960 | SEQ ID NO. 62 in WO2016014576 |
| CD33 | VH | 961 | SEQ ID NO. 63 in WO2016014576 |
| CD33 | VH | 962 | SEQ ID NO. 64 in WO2016014576 |
| CD33 | VH | 963 | SEQ ID NO. 65 in WO2016014576 |
| CD38 | VH | 964 | SEQ ID NO. 2 in WO2009080830 |
| CD38 | VH | 965 | SEQ ID No. 10 in WO2015121454 |
| CD3s | VH | 966 | SEQ ID NO: 7 in WO2014144722A2 |
| CD40 | VH | 967 | SEQ ID NO. 1 in WO2016069919 |
| CD40 | VH | 968 | SEQ ID NO. 5 in WO2015091655 |
| CD40 | VH | 969 | SEQ ID NO. 7 in WO2015091655 |
| CD40 | VH | 970 | SEQ ID NO. 8 in WO2015091655 |
| CD45 | VH | 971 | SEQIDNO: 24 in WO2016126213A1 |
| CD46 | VH | 972 | SEQ ID NO: 39 in WO2012031273 |
| CD46 | VH | 973 | SEQ ID NO: 47 in WO2012031273 |
| CD46 | VH | 974 | SEQ ID NO: 59 in WO2012031273 |
| CD46 | VH | 975 | SEQ ID NO: 15 in WO2012031273 |
| CD46 | VH | 976 | SEQ ID NO: 19 in WO2012031273 |
| CD46 | VH | 977 | SEQ ID NO: 23 in WO2012031273 |
| CD46 | VH | 978 | SEQ ID NO: 27 in WO2012031273 |
| CD46 | VH | 979 | SEQ ID NO: 31 in WO2012031273 |
| CD46 | VH | 980 | SEQ ID NO: 35 in WO2012031273 |

TABLE 10-continued

Variable Heavy and Light Chain Sequences

| Target | Antibody chain | SEQ ID NO | Source |
|---|---|---|---|
| CD46 | VH | 981 | SEQ ID NO: 43 in WO2012031273 |
| CD46 | VH | 982 | SEQ ID NO: 51 in WO2012031273 |
| CD46 | VH | 983 | SEQ ID NO: 55 in WO2012031273 |
| CD46 | VH | 984 | SEQ ID NO: 63 in WO2012031273 |
| CD46 | VH | 985 | SEQ ID NO: 67 in WO2012031273 |
| CD46 | VH | 986 | SEQ ID NO: 71 in WO2012031273 |
| CD46 | VH | 987 | SEQ ID NO: 75 in WO2012031273 |
| CD46 | VH | 988 | SEQ ID NO: 79 in WO2012031273 |
| CD46 | VH | 989 | SEQ ID NO: 83 in WO2012031273 |
| CD46 | VH | 990 | SEQ ID NO. 1 in WO2016040683 |
| CD46 | VH | 991 | SEQ ID NO. 10 in WO2016040683 |
| CD46 | VH | 992 | SEQ ID NO. 11 in WO2016040683 |
| CD46 | VH | 993 | SEQ ID NO. 12 in WO2016040683 |
| CD46 | VH | 994 | SEQ ID NO. 13 in WO2016040683 |
| CD46 | VH | 995 | SEQ ID NO. 14 in WO2016040683 |
| CD46 | VH | 996 | SEQ ID NO. 15 in WO2016040683 |
| CD46 | VH | 997 | SEQ ID NO. 16 in WO2016040683 |
| CD46 | VH | 998 | SEQ ID NO. 17 in WO2016040683 |
| CD46 | VH | 999 | SEQ ID NO. 3 in WO2016040683 |
| CD46 | VH | 1000 | SEQ ID NO. 5 in WO2016040683 |
| CD46 | VH | 1001 | SEQ ID NO. 6 in WO2016040683 |
| CD46 | VH | 1002 | SEQ ID NO. 7 in WO2016040683 |
| CD46 | VH | 1003 | SEQ ID NO. 9 in WO2016040683 |
| CD46 | VH | 1004 | SEQ ID NO. 18 in WO2016040683 |
| CD46 | VH | 1005 | SEQ ID NO. 19 in WO2016040683 |
| CD46 | VH | 1006 | SEQ ID NO. 20 in WO2016040683 |
| CD46 | VH | 1007 | SEQ ID NO. 21 in WO2016040683 |
| CD46 | VH | 1008 | SEQ ID NO: 69 in WO2012031273 |
| CD46 | VH | 1009 | SEQ ID NO: 71 in WO2012031273 |
| CD46 | VH | 1010 | SEQ ID NO: 83in WO2012031273 |
| CD4BS | VH | 1011 | SEQ ID NO: 15 in US20160194375A1 |
| CD4BS | VH | 1012 | SEQ ID NO: 3 in US20160194375A1 |
| CD4i | VH | 1013 | SEQ ID NO: 5 in US20160194375A1 |
| CD52 | VH | 1014 | SEQ ID NO: 103 in WO2010132659 |
| CD52 | VH | 1015 | SEQ ID NO: 136 in WO2010132659 |
| CD52 | VH | 1016 | SEQ ID NO: 137 in WO2010132659 |
| CD64 | VH | 1017 | SEQ ID NO. 129 in WO2016122701 |
| CD7 | VH | 1018 | SEQ IDNO: 16 in WO2016126213A1 |
| CD7 | VH | 1019 | SEQIDNO: 20 in WO2016126213A1 |
| CD70 | VH | 1020 | SEQ ID No. 81 in WO2015121454 |
| CD70 | VH | 1021 | SEQ ID NO. 85 in WO2015121454 |
| CD70 | VH | 1022 | SEQ ID NO. 89 in WO2015121454 |
| CD71 | VH | 1023 | SEQ ID NO. 1 in US20160355599 |
| CD71 | VH | 1024 | SEQ ID NO. 3 in US20160355599 |
| CD71 | VH | 1025 | SEQ ID NO. 325 in US20160355599 |
| CD71 | VH | 1026 | SEQ ID NO. 4 in US20160355599 |
| CD71 | VH | 1027 | SEQ ID NO. 5 in US20160355599 |
| CD71 | VH | 1028 | SEQ ID NO. 699 in US20160355599 |
| CD73 | VH | 1029 | SEQ ID NO. 135 in US20160145350 |
| CD73 | VH | 1030 | SEQ ID NO. 40 in US20160145350 |
| CD73 | VH | 1031 | SEQ ID NO. 21 in WO2016055609A1 |
| CD73 | VH | 1032 | SEQ ID NO. 3 in WO2016055609A1 |
| CD73 | VH | 1033 | SEQ ID NO. 28 in WO2016055609A1 |
| CD73 | VH | 1034 | SEQ ID NO. 36 in WO2016055609A1 |
| CD74 | VH | 1035 | FIG. 1A in WO2003074567 |
| CD74 | VH | 1036 | FIG. 2A in WO2003074567 |
| CD74 | VH | 1037 | FIG. 4A in WO2003074567 |
| CD74 | VH | 1038 | SEQ ID NO. 6 in US20100284906A1 |
| CD74 | VH | 1039 | SEQ ID NO 10 in US20040115193A1 |
| CD74 | VH | 1040 | SEQ ID NO 11 in US20040115193A1 |
| CD74 | VH | 1041 | SEQ ID NO 9 in US20040115193A1 |
| CD76b | VH | 1042 | SEQ ID NO. 15 in US20160159906 |
| CD76b | VH | 1043 | SEQ ID NO. 17 in US20160159906 |
| CD76b | VH | 1044 | SEQ ID NO. 19 in US20160159906 |
| CD76b | VH | 1045 | SEQ ID NO. 23 in US20160159906 |
| CD76b | VH | 1046 | SEQ ID NO. 27 in US20160159906 |
| CD76b | VH | 1047 | SEQ ID NO. 29 in US20160159906 |
| CD76b | VH | 1048 | SEQ ID NO. 37 in US20160159906 |
| CD76b | VH | 1049 | SEQ ID NO. 57 in US20160159906 |
| CD76b | VH | 1050 | SEQ ID NO. 59 in US20160159906 |
| CD76b | VH | 1051 | SEQ ID NO. 61 in US20160159906 |
| CD80 | VH | 1052 | SEQ ID NO. 131 in WO2016122701 |
| CDIM | VH | 1053 | SEQ ID NO. 1 in WO2013120012 |
| CDIM | VH | 1054 | SEQ ID NO. 10 in WO2013120012 |
| CDIM | VH | 1055 | SEQ ID NO. 11 in WO2013120012 |

TABLE 10-continued

Variable Heavy and Light Chain Sequences

| Target | Antibody chain | SEQ ID NO | Source |
|---|---|---|---|
| CDIM | VH | 1056 | SEQ ID NO. 12 in WO2013120012 |
| CDIM | VH | 1057 | SEQ ID NO. 13 in WO2013120012 |
| CDIM | VH | 1058 | SEQ ID NO. 14 in WO2013120012 |
| CDIM | VH | 1059 | SEQ ID NO. 15 in WO2013120012 |
| CDIM | VH | 1060 | SEQ ID NO. 16 in WO2013120012 |
| CDIM | VH | 1061 | SEQ ID NO. 17 in WO2013120012 |
| CDIM | VH | 1062 | SEQ ID NO. 18 in WO2013120012 |
| CDIM | VH | 1063 | SEQ ID NO. 19 in WO2013120012 |
| CDIM | VH | 1064 | SEQ ID NO. 2 in WO2013120012 |
| CDIM | VH | 1065 | SEQ ID NO. 20 in WO2013120012 |
| CDIM | VH | 1066 | SEQ ID NO. 21 in WO2013120012 |
| CDIM | VH | 1067 | SEQ ID NO. 22 in WO2013120012 |
| CDIM | VH | 1068 | SEQ ID NO. 3 in WO2013120012 |
| CDIM | VH | 1069 | SEQ ID NO. 4 in WO2013120012 |
| CDIM | VH | 1070 | SEQ ID NO. 5 in WO2013120012 |
| CDIM | VH | 1071 | SEQ ID NO. 6 in WO2013120012 |
| CDIM | VH | 1072 | SEQ ID NO. 7 in WO2013120012 |
| CDIM | VH | 1073 | SEQ ID NO. 8 in WO2013120012 |
| CDIM | VH | 1074 | SEQ ID NO. 9 in WO2013120012 |
| CEA | VH | 1075 | SEQ ID NO: 8 in U.S. Pat. No. 8,287,865 |
| Claudin | VH | 1076 | SEQ ID NO. 101 in WO2016073649A1 |
| Claudin | VH | 1077 | SEQ ID NO. 103 in WO2016073649A1 |
| Claudin | VH | 1078 | SEQ ID NO. 105 in WO2016073649A1 |
| Claudin | VH | 1079 | SEQ ID NO. 107 in WO2016073649A1 |
| Claudin | VH | 1080 | SEQ ID NO. 109 in WO2016073649A1 |
| Claudin | VH | 1081 | SEQ ID NO. 111 in WO2016073649A1 |
| Claudin | VH | 1082 | SEQ ID NO. 113 in WO2016073649A1 |
| Claudin | VH | 1083 | SEQ ID NO. 115 in WO2016073649A1 |
| Claudin | VH | 1084 | SEQ ID NO. 117 in WO2016073649A1 |
| Claudin | VH | 1085 | SEQ ID NO. 119 in WO2016073649A1 |
| Claudin | VH | 1086 | SEQ ID NO. 121 in WO2016073649A1 |
| Claudin | VH | 1087 | SEQ ID NO. 122 in WO2016073649A1 |
| Claudin | VH | 1088 | SEQ ID NO. 123 in WO2016073649A1 |
| Claudin | VH | 1089 | SEQ ID NO. 124 in WO2016073649A1 |
| Claudin | VH | 1090 | SEQ ID NO. 125 in WO2016073649A1 |
| Claudin | VH | 1091 | SEQ ID NO. 126 in WO2016073649A1 |
| Claudin | VH | 1092 | SEQ ID NO. 127 in WO2016073649A1 |
| Claudin | VH | 1093 | SEQ ID NO. 128 in WO2016073649A1 |
| Claudin | VH | 1094 | SEQ ID NO. 129 in WO2016073649A1 |
| Claudin | VH | 1095 | SEQ ID NO. 130 in WO2016073649A1 |
| Claudin | VH | 1096 | SEQ ID NO. 131 in WO2016073649A1 |
| Claudin | VH | 1097 | SEQ ID NO. 132 in WO2016073649A1 |
| Claudin | VH | 1098 | SEQ ID NO. 133 in WO2016073649A1 |
| Claudin | VH | 1099 | SEQ ID NO. 134 in WO2016073649A1 |
| Claudin | VH | 1100 | SEQ ID NO. 135 in WO2016073649A1 |
| Claudin | VH | 1101 | SEQ ID NO. 136 in WO2016073649A1 |
| Claudin | VH | 1102 | SEQ ID NO. 137 in WO2016073649A1 |
| Claudin | VH | 1103 | SEQ ID NO. 138 in WO2016073649A1 |
| Claudin | VH | 1104 | SEQ ID NO. 139 in WO2016073649A1 |
| Claudin | VH | 1105 | SEQ ID NO. 140 in WO2016073649A1 |
| Claudin | VH | 1106 | SEQ ID NO. 141 in WO2016073649A1 |
| Claudin | VH | 1107 | SEQ ID NO. 142 in WO2016073649A1 |
| Claudin | VH | 1108 | SEQ ID NO. 143 in WO2016073649A1 |
| Claudin | VH | 1109 | SEQ ID NO. 144 in WO2016073649A1 |
| Claudin | VH | 1110 | SEQ ID NO. 145 in WO2016073649A1 |
| Claudin | VH | 1111 | SEQ ID NO. 146 in WO2016073649A1 |
| Claudin | VH | 1112 | SEQ ID NO. 147 in WO2016073649A1 |
| Claudin | VH | 1113 | SEQ ID NO. 148 in WO2016073649A1 |
| Claudin | VH | 1114 | SEQ ID NO. 149 in WO2016073649A1 |
| Claudin | VH | 1115 | SEQ ID NO. 150 in WO2016073649A1 |
| Claudin | VH | 1116 | SEQ ID NO. 23 in WO2016073649A1 |
| Claudin | VH | 1117 | SEQ ID NO. 27 in WO2016073649A1 |
| Claudin | VH | 1118 | SEQ ID NO. 31 in WO2016073649A1 |
| Claudin | VH | 1119 | SEQ ID NO. 35 in WO2016073649A1 |
| Claudin | VH | 1120 | SEQ ID NO. 39 in WO2016073649A1 |
| Claudin | VH | 1121 | SEQ ID NO. 43 in WO2016073649A1 |
| Claudin | VH | 1122 | SEQ ID NO. 47 in WO2016073649A1 |
| Claudin | VH | 1123 | SEQ ID NO. 51 in WO2016073649A1 |
| Claudin | VH | 1124 | SEQ ID NO. 55 in WO2016073649A1 |
| Claudin | VH | 1125 | SEQ ID NO. 59 in WO2016073649A1 |
| Claudin | VH | 1126 | SEQ ID NO. 63 in WO2016073649A1 |
| Claudin | VH | 1127 | SEQ ID NO. 67 in WO2016073649A1 |
| Claudin | VH | 1128 | SEQ ID NO. 71 in WO2016073649A1 |
| Claudin | VH | 1129 | SEQ ID NO. 75 in WO2016073649A1 |
| Claudin | VH | 1130 | SEQ ID NO. 79 in WO2016073649A1 |

TABLE 10-continued

Variable Heavy and Light Chain Sequences

| Target | Antibody chain | SEQ ID NO | Source |
|---|---|---|---|
| Claudin | VH | 1131 | SEQ ID NO. 81 in WO2016073649A1 |
| Claudin | VH | 1132 | SEQ ID NO. 83 in WO2016073649A1 |
| Claudin | VH | 1133 | SEQ ID NO. 85 in WO2016073649A1 |
| Claudin | VH | 1134 | SEQ ID NO. 87 in WO2016073649A1 |
| Claudin | VH | 1135 | SEQ ID NO. 89 in WO2016073649A1 |
| Claudin | VH | 1136 | SEQ ID NO. 91 in WO2016073649A1 |
| Claudin | VH | 1137 | SEQ ID NO. 93 in WO2016073649A1 |
| Claudin | VH | 1138 | SEQ ID NO. 95 in WO2016073649A1 |
| Claudin | VH | 1139 | SEQ ID NO. 97 in WO2016073649A1 |
| Claudin | VH | 1140 | SEQ ID NO. 99 in WO2016073649A1 |
| CLL1 | VH | 1141 | SEQ ID NO. 13 in WO2016120219 |
| CLL1 | VH | 1142 | SEQ ID NO. 14 in WO2016120219 |
| CLL1 | VH | 1143 | SEQ ID NO. 15 in WO2016120219 |
| CLL1 | VH | 1144 | SEQ ID NO. 17 in WO2016120219 |
| CLL1 | VH | 1145 | SEQ ID NO. 19 in WO2016120219 |
| CLL1 | VH | 1146 | SEQ ID NO. 195 in WO2016014535 |
| CLL1 | VH | 1147 | SEQ ID NO. 21 in WO2016120219 |
| CLL1 | VH | 1148 | SEQ ID NO. 23 in WO2016120219 |
| CLL1 | VH | 1149 | SEQ ID NO. 25 in WO2016120219 |
| CLL1 | VH | 1150 | SEQ ID NO. 27 in WO2016120219 |
| CLL1 | VH | 1151 | SEQ ID NO. 29 in WO2016120219 |
| CLL1 | VH | 1152 | SEQ ID NO. 31 in WO2016120219 |
| CLL1 | VH | 1153 | SEQ ID NO. 33 in WO2016120219 |
| CLL1 | VH | 1154 | SEQ ID NO. 35 in WO2016120219 |
| CLL1 | VH | 1155 | SEQ ID NO. 65 in WO2016014535 |
| CLL1 | VH | 1156 | SEQ ID NO. 66 in WO2016014535 |
| CLL1 | VH | 1157 | SEQ ID NO. 67 in WO2016014535 |
| CLL1 | VH | 1158 | SEQ ID NO. 68 in WO2016014535 |
| CLL1 | VH | 1159 | SEQ ID NO. 69 in WO2016014535 |
| CLL1 | VH | 1160 | SEQ ID NO. 70 in WO2016014535 |
| CLL1 | VH | 1161 | SEQ ID NO. 71 in WO2016014535 |
| CLL1 | VH | 1162 | SEQ ID NO. 72 in WO2016014535 |
| CLL1 | VH | 1163 | SEQ ID NO. 73 in WO2016014535 |
| CLL1 | VH | 1164 | SEQ ID NO. 74 in WO2016014535 |
| CLL1 | VH | 1165 | SEQ ID NO. 75 in WO2016014535 |
| CLL1 | VH | 1166 | SEQ ID NO. 76 in WO2016014535 |
| CLL1 | VH | 1167 | SEQ ID NO. 77 in WO2016014535 |
| CLL1 | VH | 1168 | SEQ ID NO. 31 in US20160075787 |
| CLL1 | VH | 1169 | SEQ ID NO. 33 in US20160075787 |
| CLL1 | VH | 1170 | SEQ ID NO. 34 in US20160075787 |
| CLL1 | VH | 1171 | SEQ ID NO. 36 in US20160075787 |
| CLL1 | VH | 1172 | SEQ ID NO. 38 in US20160075787 |
| CLL1 | VH | 1173 | SEQ ID NO. 40 in US20160075787 |
| CLL1 | VH | 1174 | SEQ ID NO. 42 in US20160075787 |
| CLL1 | VH | 1175 | SEQ ID NO. 46 in US20160075787 |
| CLL1 | VH | 1176 | SEQ ID NO: 150 in WO2016179319A1 |
| CLL1 | VH | 1177 | SEQ ID NO: 103 in WO2016179319A1 |
| CLL1 | VH | 1178 | SEQ ID NO: 105 in WO2016179319A1 |
| CLL1 | VH | 1179 | SEQ ID NO: 107 in WO2016179319A1 |
| CLL1 | VH | 1180 | SEQ ID NO: 109 in WO2016179319A1 |
| CLL1 | VH | 1181 | SEQ ID NO: 111 in WO2016179319A1 |
| CLL1 | VH | 1182 | SEQ ID NO: 113 in WO2016179319A1 |
| CLL1 | VH | 1183 | SEQ ID NO: 115 in WO2016179319A1 |
| CLL1 | VH | 1184 | SEQ ID NO: 117 in WO2016179319A1 |
| CLL3 | VH | 1185 | SEQ ID NO. 101 in US2017000901 |
| CLL3 | VH | 1186 | SEQ ID NO. 103 in US20170000901 |
| CLL3 | VH | 1187 | SEQ ID NO. 105 in US20170000901 |
| CLL3 | VH | 1188 | SEQ ID NO. 107 in US20170000901 |
| CLL3 | VH | 1189 | SEQ ID NO. 109 in US20170000901 |
| CLL3 | VH | 1190 | SEQ ID NO. 111 in US20170000901 |
| CLL3 | VH | 1191 | SEQ ID NO. 113 in US20170000901 |
| CLL3 | VH | 1192 | SEQ ID NO. 115 in US20170000901 |
| CLL3 | VH | 1193 | SEQ ID NO. 117 in US20170000901 |
| CLL3 | VH | 1194 | SEQ ID NO. 119 in US20170000901 |
| CLL3 | VH | 1195 | SEQ ID NO. 121 in US20170000901 |
| CLL3 | VH | 1196 | SEQ ID NO. 123 in US20170000901 |
| CLL3 | VH | 1197 | SEQ ID NO. 125 in US20170000901 |
| CLL3 | VH | 1198 | SEQ ID NO. 127 in US20170000901 |
| CLL3 | VH | 1199 | SEQ ID NO. 129 in US20170000901 |
| CLL3 | VH | 1200 | SEQ ID NO. 131 in US20170000901 |
| CLL3 | VH | 1201 | SEQ ID NO. 133 in US20170000901 |
| CLL3 | VH | 1202 | SEQ ID NO. 135 in US20170000901 |
| CLL3 | VH | 1203 | SEQ ID NO. 137 in US20170000901 |
| CLL3 | VH | 1204 | SEQ ID NO. 139 in US20170000901 |
| CLL3 | VH | 1205 | SEQ ID NO. 141 in US20170000901 |

TABLE 10-continued

Variable Heavy and Light Chain Sequences

| Target | Antibody chain | SEQ ID NO | Source |
|---|---|---|---|
| CLL3 | VH | 1206 | SEQ ID NO. 145 in US20170000901 |
| CLL3 | VH | 1207 | SEQ ID NO. 147 in US20170000901 |
| CLL3 | VH | 1208 | SEQ ID NO. 149 in US20170000901 |
| CLL3 | VH | 1209 | SEQ ID NO. 151 in US20170000901 |
| CLL3 | VH | 1210 | SEQ ID NO. 153 in US20170000901 |
| CLL3 | VH | 1211 | SEQ ID NO. 155 in US20170000901 |
| CLL3 | VH | 1212 | SEQ ID NO. 157 in US20170000901 |
| CLL3 | VH | 1213 | SEQ ID NO. 159 in US20170000901 |
| CLL3 | VH | 1214 | SEQ ID NO. 161 in US20170000901 |
| CLL3 | VH | 1215 | SEQ ID NO. 163 in US20170000901 |
| CLL3 | VH | 1216 | SEQ ID NO. 165 in US20170000901 |
| CLL3 | VH | 1217 | SEQ ID NO. 167 in US20170000901 |
| CLL3 | VH | 1218 | SEQ ID NO. 169 in US20170000901 |
| CLL3 | VH | 1219 | SEQ ID NO. 171 in US20170000901 |
| CLL3 | VH | 1220 | SEQ ID NO. 173 in US20170000901 |
| CLL3 | VH | 1221 | SEQ ID NO. 175 in US20170000901 |
| CLL3 | VH | 1222 | SEQ ID NO. 177 in US20170000901 |
| CLL3 | VH | 1223 | SEQ ID NO. 179 in US20170000901 |
| CLL3 | VH | 1224 | SEQ ID NO. 181 in US20170000901 |
| CLL3 | VH | 1225 | SEQ ID NO. 183 in US20170000901 |
| CLL3 | VH | 1226 | SEQ ID NO. 185 in US20170000901 |
| CLL3 | VH | 1227 | SEQ ID NO. 187 in US20170000901 |
| CLL3 | VH | 1228 | SEQ ID NO. 191 in US20170000901 |
| CLL3 | VH | 1229 | SEQ ID NO. 193 in US20170000901 |
| CLL3 | VH | 1230 | SEQ ID NO. 195 in US20170000901 |
| CLL3 | VH | 1231 | SEQ ID NO. 197 in US20170000901 |
| CLL3 | VH | 1232 | SEQ ID NO. 199 in US20170000901 |
| CLL3 | VH | 1233 | SEQ ID NO. 201 in US20170000901 |
| CLL3 | VH | 1234 | SEQ ID NO. 203 in US20170000901 |
| CLL3 | VH | 1235 | SEQ ID NO. 205 in US20170000901 |
| CLL3 | VH | 1236 | SEQ ID NO. 207 in US20170000901 |
| CLL3 | VH | 1237 | SEQ ID NO. 209 in US20170000901 |
| CLL3 | VH | 1238 | SEQ ID NO. 21 in US20170000901 |
| CLL3 | VH | 1239 | SEQ ID NO. 211 in US20170000901 |
| CLL3 | VH | 1240 | SEQ ID NO. 213 in US20170000901 |
| CLL3 | VH | 1241 | SEQ ID NO. 23 in US20170000901 |
| CLL3 | VH | 1242 | SEQ ID NO. 25 in US20170000901 |
| CLL3 | VH | 1243 | SEQ ID NO. 27 in US20170000901 |
| CLL3 | VH | 1244 | SEQ ID NO. 29 in US20170000901 |
| CLL3 | VH | 1245 | SEQ ID NO. 31 in US20170000901 |
| CLL3 | VH | 1246 | SEQ ID NO. 33 in US20170000901 |
| CLL3 | VH | 1247 | SEQ ID NO. 35 in US20170000901 |
| CLL3 | VH | 1248 | SEQ ID NO. 37 in US20170000901 |
| CLL3 | VH | 1249 | SEQ ID NO. 39 in US20170000901 |
| CLL3 | VH | 1250 | SEQ ID NO. 41 in US20170000901 |
| CLL3 | VH | 1251 | SEQ ID NO. 43 in US20170000901 |
| CLL3 | VH | 1252 | SEQ ID NO. 45 in US20170000901 |
| CLL3 | VH | 1253 | SEQ ID NO. 47 in US20170000901 |
| CLL3 | VH | 1254 | SEQ ID NO. 49 in US20170000901 |
| CLL3 | VH | 1255 | SEQ ID NO. 51 in US20170000901 |
| CLL3 | VH | 1256 | SEQ ID NO. 53 in US20170000901 |
| CLL3 | VH | 1257 | SEQ ID NO. 55 in US20170000901 |
| CLL3 | VH | 1258 | SEQ ID NO. 57 in US20170000901 |
| CLL3 | VH | 1259 | SEQ ID NO. 59 in US20170000901 |
| CLL3 | VH | 1260 | SEQ ID NO. 61 in US20170000901 |
| CLL3 | VH | 1261 | SEQ ID NO. 63 in US20170000901 |
| CLL3 | VH | 1262 | SEQ ID NO. 65 in US20170000901 |
| CLL3 | VH | 1263 | SEQ ID NO. 67 in US20170000901 |
| CLL3 | VH | 1264 | SEQ ID NO. 69 in US20170000901 |
| CLL3 | VH | 1265 | SEQ ID NO. 71 in US20170000901 |
| CLL3 | VH | 1266 | SEQ ID NO. 73 in US20170000901 |
| CLL3 | VH | 1267 | SEQ ID NO. 75 in US20170000901 |
| CLL3 | VH | 1268 | SEQ ID NO. 77 in US20170000901 |
| CLL3 | VH | 1269 | SEQ ID NO. 79 in US20170000901 |
| CLL3 | VH | 1270 | SEQ ID NO. 81 in US20170000901 |
| CLL3 | VH | 1271 | SEQ ID NO. 83 in US20170000901 |
| CLL3 | VH | 1272 | SEQ ID NO. 85 in US20170000901 |
| CLL3 | VH | 1273 | SEQ ID NO. 87 in US20170000901 |
| CLL3 | VH | 1274 | SEQ ID NO. 89 in US20170000901 |
| CLL3 | VH | 1275 | SEQ ID NO. 91 in US20170000901 |
| CLL3 | VH | 1276 | SEQ ID NO. 93 in US2017000901 |
| CLL3 | VH | 1277 | SEQ ID NO. 95 in US20170000901 |
| CLL3 | VH | 1278 | SEQ ID NO. 97 in US20170000901 |
| CLL3 | VH | 1279 | SEQ ID NO. 99 in US20170000901 |
| collagen | VH | 1280 | SEQ ID NO. 21 in WO2007024921 |

TABLE 10-continued

Variable Heavy and Light Chain Sequences

| Target | Antibody chain | SEQ ID NO | Source |
|---|---|---|---|
| collagen | VH | 1281 | SEQ ID NO. 4 in WO2007024921 |
| collagen | VH | 1282 | SEQ ID NO. 15 in WO2007024921 |
| collagen | VH | 1283 | SEQ ID NO. 17 in WO2007024921 |
| collagen | VH | 1284 | SEQ ID NO. 18 in WO2007024921 |
| collagen | VH | 1285 | SEQ ID NO. 19 in WO2007024921 |
| collagen | VH | 1286 | SEQ ID NO. 20 in WO2007024921 |
| collagen | VH | 1287 | SEQ ID NO. 5 in WO2007024921 |
| collagen | VH | 1288 | SEQ ID NO. 6 in WO2007024921 |
| collagen | VH | 1289 | SEQ ID NO. 7 in WO2007024921 |
| collagen | VH | 1290 | SEQ ID NO: 1 in WO2007024921 |
| collagen | VH | 1291 | SEQ ID NO: 2 in WO2007024921 |
| collagen | VH | 1292 | SEQ ID NO: 3 in WO2007024921 |
| CS1 | VH | 1293 | SEQ ID NO: 22 in WO2016168773A3 |
| CS1 | VH | 1294 | SEQ ID NO. 103 in WO2016120216 |
| CS1 | VH | 1295 | SEQ ID NO. 105 in WO2016120216 |
| CS1 | VH | 1296 | SEQ ID NO. 107 in WO2016120216 |
| CS1 | VH | 1297 | SEQ ID NO. 109 in WO2016120216 |
| CS1 | VH | 1298 | SEQ ID NO. 13 in WO2015166056A1 |
| CS1 | VH | 1299 | SEQ ID NO. 15 in WO2015166056A1 |
| CS1 | VH | 1300 | SEQ ID NO. 17 in WO2015166056A1 |
| CS1 | VH | 1301 | SEQ ID NO. 19 in WO2015166056A1 |
| CS1 | VH | 1302 | SEQ ID No. 38 in WO2015121454 |
| CS1 | VH | 1303 | SEQ ID No. 40 in WO2015121454 |
| CS1 | VH | 1304 | SEQ ID No. 42 in WO2015121454 |
| CS1 | VH | 1305 | SEQ ID No. 44 in WO2015121454 |
| CS1 | VH | 1306 | SEQ ID No. 46 in WO2015121454 |
| CS1 | VH | 1307 | SEQ ID NO. 26 in US20160075784A1 |
| CSF | VH | 1308 | SEQ ID NO 10 in US20050059113A1 |
| CSF | VH | 1309 | SEQ ID NO 102 in US20050059113A1 |
| CSF | VH | 1310 | SEQ ID NO 14 in US20050059113A1 |
| CSF | VH | 1311 | SEQ ID NO 18 in US20050059113A1 |
| CSF | VH | 1312 | SEQ ID NO 2 in US20050059113A1 |
| CSF | VH | 1313 | SEQ ID NO 22 in US20050059113A1 |
| CSF | VH | 1314 | SEQ ID NO 26 in US20050059113A1 |
| CSF | VH | 1315 | SEQ ID NO 30 in US20050059113A1 |
| CSF | VH | 1316 | SEQ ID NO 34 in US20050059113A1 |
| CSF | VH | 1317 | SEQ ID NO 38 in US20050059113A1 |
| CSF | VH | 1318 | SEQ ID NO 46 in US20050059113A1 |
| CSF | VH | 1319 | SEQ ID NO 50 in US20050059113A1 |
| CSF | VH | 1320 | SEQ ID NO 54 in US20050059113A1 |
| CSF | VH | 1321 | SEQ ID NO 58 in US20050059113A1 |
| CSF | VH | 1322 | SEQ ID NO 6 in US20050059113A1 |
| CSF | VH | 1323 | SEQ ID NO 62 in US20050059113A1 |
| CSF | VH | 1324 | SEQ ID NO 66 in US20050059113A1 |
| CSF | VH | 1325 | SEQ ID NO 70 in US20050059113A1 |
| CSF | VH | 1326 | SEQ ID NO 74 in US20050059113A1 |
| CSF | VH | 1327 | SEQ ID NO 78 in US20050059113A1 |
| CSF | VH | 1328 | SEQ ID NO 82 in US20050059113A1 |
| CSF | VH | 1329 | SEQ ID NO 86 in US20050059113A1 |
| CSF | VH | 1330 | SEQ ID NO 90 in US20050059113A1 |
| CSF | VH | 1331 | SEQ ID NO 94 in US20050059113A1 |
| CSF | VH | 1332 | SEQ ID NO 98 in US20050059113A1 |
| CSPG4 | VH | 1333 | SEQ ID NO. 8 in WO2016164429 |
| CTLA4 | VH | 1334 | SEQ ID NO. 3 in US20140105914 |
| CTLA4 | VH | 1335 | SEQ ID NO. 31 in US20140105914 |
| CTLA4 | VH | 1336 | SEQ ID NO. 32 in US20140105914 |
| CTLA4 | VH | 1337 | SEQ ID NO. 33 in US20140105914 |
| CTLA4 | VH | 1338 | SEQ ID NO. 34 in US20140105914 |
| CTLA4 | VH | 1339 | SEQ ID NO. 35 in US20140105914 |
| CTLA4 | VH | 1340 | SEQ ID NO. 4 in U.S. Pat. No. 8,697,845 |
| CTLA4 | VH | 1341 | SEQ ID NO. 41 in US20140105914 |
| CTLA4 | VH | 1342 | SEQ ID NO. 42 in US20140105914 |
| CTLA4 | VH | 1343 | SEQ ID NO. 43 in US20140105914 |
| CTLA4 | VH | 1344 | SEQ ID NO. 44 in US20140105914 |
| CTLA4 | VH | 1345 | SEQ ID NO. 45 in US20140105914 |
| CTLA4 | VH | 1346 | SEQ ID NO. 7 in US20140105914 |
| CTLA4(Ipilimumab) | VH | 1347 | SEQ ID NO. 19 in US20150283234 |
| CTLA4(Ipilimumab) | VH | 1348 | SEQ ID NO. 17 in WO2014066532 |
| CXCR4 | VH | 1349 | SEQ ID NO: 72 in US20110020218 |
| CXCR4 | VH | 1350 | SEQ ID NO: 73 in US20110020218 |
| CXCR4 | VH | 1351 | SEQ ID NO: 74 in US20110020218 |
| CXCR4 | VH | 1352 | SEQ ID NO: 75 in US20110020218 |
| CXCR4 | VH | 1353 | SEQ ID NO: 84 in US20110020218 |
| Daclizumab | VH | 1354 | SEQ ID NO: 44 in US20160333114A1 |
| Daclizumab | VH | 1355 | SEQ ID NO: 46 in US20160333114A1 |

TABLE 10-continued

Variable Heavy and Light Chain Sequences

| Target | Antibody chain | SEQ ID NO | Source |
|---|---|---|---|
| DR5 | VH | 1356 | SEQ ID NO. 18 in WO2016122701 |
| DR5 | VH | 1357 | SEQ ID NO. 82 in WO2016122701 |
| DR5 | VH | 1358 | SEQ ID NO. 90 in WO2016122701 |
| DR5 | VH | 1359 | SEQ ID NO. 98 in WO2016122701 |
| DR5 | VH | 1360 | SEQ ID NO. 8 in WO2016122701 |
| DR5(Conatumumab) | VH | 1361 | SEQ ID NO. 66 in WO2016122701 |
| DR5(Drozitumab) | VH | 1362 | SEQ ID NO. 58 in WO2016122701 |
| DR5(Tigatuzumab) | VH | 1363 | SEQ ID NO. 74 in WO2016122701 |
| E7MC | VH | 1364 | SEQ ID NO: 15 in WO2016182957A1 |
| E7MC | VH | 1365 | SEQ ID NO: 16 in WO2016182957A1 |
| E7MC | VH | 1366 | SEQ ID NO: 17 in WO2016182957A1 |
| E7MC | VH | 1367 | SEQ ID NO: 18 in WO2016182957A1 |
| E7MC | VH | 1368 | SEQ ID NO: 19 in WO2016182957A1 |
| E7MC | VH | 1369 | SEQ ID NO: 20 in WO2016182957A1 |
| E7MC | VH | 1370 | SEQ ID NO: 21 in WO2016182957A1 |
| E7MC | VH | 1371 | SEQ ID NO: 22 in WO2016182957A1 |
| E7MC | VH | 1372 | SEQ ID NO: 23 in WO2016182957A1 |
| E7MC | VH | 1373 | SEQ ID NO: 233 in WO2016182957A1 |
| E7MC | VH | 1374 | SEQ ID NO: 234 in WO2016182957A1 |
| E7MC | VH | 1375 | SEQ ID NO: 235 in WO2016182957A1 |
| E7MC | VH | 1376 | SEQ ID NO: 236 in WO2016182957A1 |
| E7MC | VH | 1377 | SEQ ID NO: 237 in WO2016182957A1 |
| E7MC | VH | 1378 | SEQ ID NO: 24 in WO2016182957A1 |
| E7MC | VH | 1379 | SEQ ID NO: 25 in WO2016182957A1 |
| E7MC | VH | 1380 | SEQ ID NO: 26 in WO2016182957A1 |
| E7MC | VH | 1381 | SEQ ID NO: 27 in WO2016182957A1 |
| E7MC | VH | 1382 | SEQ ID NO: 28 in WO2016182957A1 |
| E7MC | VH | 1383 | SEQ ID NO: 29 in WO2016182957A1 |
| E7MC | VH | 1384 | SEQ ID NO: 30 in WO2016182957A1 |
| E7MC | VH | 1385 | SEQ ID NO: 31 in WO2016182957A1 |
| E7MC | VH | 1386 | SEQ ID NO: 32 in WO2016182957A1 |
| E7MC | VH | 1387 | SEQ ID NO: 33 in WO2016182957A1 |
| E7MC | VH | 1388 | SEQ ID NO: 34 in WO2016182957A1 |
| E7MC | VH | 1389 | SEQ ID NO: 35 in WO2016182957A1 |
| EFNA | VH | 1390 | SEQ ID NO: 149 in WO2012118547 |
| EFNA | VH | 1391 | SEQ ID NO: 153 in WO2012118547 |
| EFNA | VH | 1392 | SEQ ID NO: 157 in WO2012118547 |
| EFNA | VH | 1393 | SEQ ID NO: 161 in WO2012118547 |
| EFNA4 | VH | 1394 | SEQ ID NO. 13 in US20150125472 |
| EFNA4 | VH | 1395 | SEQ ID NO. 39 in US20150125472 |
| EGFR | VH | 1396 | SEQ ID NO. 14 in WO2015143382 |
| EGFR | VH | 1397 | SEQ ID NO. 50 in WO2015143382 |
| EGFR | VH | 1398 | SEQ ID NO. 9 in WO2015143382 |
| EGFR | VH | 1399 | SEQ ID NO. 12 in US20100008978A1 |
| EGFR | VH | 1400 | SEQ ID NO. 14 in US20100008978A1 |
| EGFR | VH | 1401 | SEQ ID NO. 15 in US20100008978A1 |
| EGFR | VH | 1402 | SEQ ID NO. 21 in US20100008978A1 |
| EGFR | VH | 1403 | |
| EGFR | VH | 1404 | |
| EGFR | VH | 1405 | |
| EGFR | VH | 1406 | |
| EGFR | VH | 1407 | |
| EGFR | VH | 1408 | |
| EGFR | VH | 1409 | |
| EGFR | VH | 1410 | |
| EGFR | VH | 1411 | |
| EGFR | VH | 1412 | |
| EGFR | VH | 1413 | |
| EGFR | VH | 1414 | |
| EGFR | VH | 1415 | |
| EGFR | VH | 1416 | |
| EGFR | VH | 1417 | |
| EGFR | VH | 1418 | |
| EGFR | VH | 1419 | |
| EGFR | VH | 1420 | |
| EGFR | VH | 1421 | |
| EGFR | VH | 1422 | |
| EGFR | VH | 1423 | |
| EGFR | VH | 1424 | |
| EGFR | VH | 1425 | |
| EGFR | VH | 1426 | |
| EGFR | VH | 1427 | |
| EGFR | VH | 1428 | |
| EGFR | VH | 1429 | |
| EGFR | VH | 1430 | |

TABLE 10-continued

Variable Heavy and Light Chain Sequences

| Target | Antibody chain | SEQ ID NO | Source |
|---|---|---|---|
| EGFR | VH | 1431 | |
| EGFR | VH | 1432 | |
| EGFR | VH | 1433 | |
| EGFR | VH | 1434 | |
| EGFR | VH | 1435 | |
| EGFR | VH | 1436 | |
| EGFR | VH | 1437 | |
| EGFR | VH | 1438 | |
| EGFR | VH | 1439 | |
| EGFR | VH | 1440 | |
| EGFR | VH | 1441 | |
| EGFR | VH | 1442 | |
| EGFR | VH | 1443 | |
| EGFR | VH | 1444 | |
| EGFR | VH | 1445 | |
| EGFR | VH | 1446 | |
| EGFR | VH | 1447 | |
| EGFR | VH | 1448 | |
| EGFR | VH | 1449 | |
| EGFR | VH | 1450 | |
| EGFR | VH | 1451 | |
| EGFR | VH | 1452 | |
| EGFR | VH | 1453 | |
| EGFR | VH | 1454 | |
| EGFR | VH | 1455 | |
| EGFR | VH | 1456 | |
| EGFR | VH | 1457 | |
| EGFR | VH | 1458 | |
| EGFR | VH | 1459 | |
| EGFR | VH | 1460 | |
| EGFR | VH | 1461 | |
| EGFR | VH | 1462 | |
| EGFR | VH | 1463 | |
| EGFR | VH | 1464 | |
| EGFR | VH | 1465 | |
| EGFR | VH | 1466 | |
| EGFR | VH | 1467 | |
| EGFR | VH | 1468 | |
| EGFR | VH | 1469 | |
| EGFR | VH | 1470 | |
| EGFR | VH | 1471 | |
| EGFR | VH | 1472 | |
| EGFR | VH | 1473 | |
| EGFR | VH | 1474 | |
| EGFR | VH | 1475 | |
| EGFR | VH | 1476 | |
| EGFR | VH | 1477 | |
| EGFR | VH | 1478 | |
| EGFR | VH | 1479 | |
| EGFR | VH | 1480 | |
| EGFR | VH | 1481 | |
| EGFR | VH | 1482 | |
| EGFR | VH | 1483 | |
| EGFR | VH | 1484 | |
| EGFR | VH | 1485 | |
| EGFR | VH | 1486 | |
| EGFR | VH | 1487 | |
| EGFR | VH | 1488 | |
| EGFR | VH | 1489 | |
| EGFR | VH | 1490 | |
| EGFR | VH | 1491 | |
| EGFR | VH | 1492 | |
| EGFR | VH | 1493 | |
| EGFR | VH | 1494 | |
| EGFR | VH | 1495 | |
| EGFR | VH | 1496 | |
| EGFR | VH | 1497 | |
| EGFR | VH | 1498 | |
| EGFR | VH | 1499 | |
| EGFR | VH | 1500 | |
| EGFR | VH | 1501 | |
| EGFR | VH | 1502 | |
| EGFR | VH | 1503 | |
| EGFR | VH | 1504 | |
| EGFR | VH | 1505 | |

TABLE 10-continued

| Variable Heavy and Light Chain Sequences | | | |
|---|---|---|---|
| Target | Antibody chain | SEQ ID NO | Source |
| EGFR | VH | 1506 | |
| EGFR | VH | 1507 | |
| EGFR | VH | 1508 | |
| EGFR | VH | 1509 | |
| EGFR | VH | 1510 | |
| EGFR | VH | 1511 | |
| EGFR | VH | 1512 | |
| EGFR | VH | 1513 | |
| EGFR | VH | 1514 | |
| EGFR | VH | 1515 | |
| EGFR | VH | 1516 | |
| EGFR | VH | 1517 | |
| EGFR | VH | 1518 | |
| EGFR | VH | 1519 | |
| EGFR | VH | 1520 | |
| EGFR | VH | 1521 | |
| EGFR | VH | 1522 | |
| EGFR | VH | 1523 | |
| EGFR | VH | 1524 | |
| EGFR | VH | 1525 | |
| EGFR | VH | 1526 | |
| EGFR | VH | 1527 | |
| EGFR | VH | 1528 | |
| EGFR | VH | 1529 | |
| EGFR | VH | 1530 | |
| EGFR | VH | 1531 | |
| EGFR | VH | 1532 | |
| EGFR | VH | 1533 | |
| EGFR | VH | 1534 | |
| EGFR | VH | 1535 | |
| EGFR | VH | 1536 | |
| EGFR | VH | 1537 | |
| EGFR | VH | 1538 | |
| EGFR | VH | 1539 | |
| EGFR | VH | 1540 | |
| EGFR | VH | 1541 | |
| EGFR | VH | 1542 | |
| EGFR | VH | 1543 | |
| EGFR | VH | 1544 | |
| EGFR | VH | 1545 | |
| EGFR | VH | 1546 | |
| EGFR | VH | 1547 | |
| EGFR | VH | 1548 | |
| EGFR | VH | 1549 | |
| EGFR | VH | 1550 | |
| EGFR | VH | 1551 | |
| EGFR | VH | 1552 | |
| EGFR | VH | 1553 | |
| EGFR | VH | 1554 | |
| EGFR | VH | 1555 | |
| EGFR | VH | 1556 | |
| EGFR | VH | 1557 | |
| EGFR | VH | 1558 | |
| EGFR | VH | 1559 | |
| EGFR | VH | 1560 | |
| EGFR | VH | 1561 | |
| EGFR | VH | 1562 | |
| EGFR | VH | 1563 | |
| EGFR | VH | 1564 | |
| EGFR | VH | 1565 | |
| EGFR | VH | 1566 | |
| EGFR | VH | 1567 | |
| EGFR | VH | 1568 | |
| EGFR | VH | 1569 | |
| EGFR | VH | 1570 | |
| EGFR | VH | 1571 | |
| EGFR | VH | 1572 | |
| EGFR | VH | 1573 | |
| EGFR | VH | 1574 | |
| EGFR | VH | 1575 | |
| EGFR | VH | 1576 | |
| EGFR | VH | 1577 | |
| EGFR | VH | 1578 | |
| EGFR | VH | 1579 | |
| EGFR | VH | 1580 | |

TABLE 10-continued

Variable Heavy and Light Chain Sequences

| Target | Antibody chain | SEQ ID NO | Source |
|---|---|---|---|
| EGFR | VH | 1581 | |
| EGFR | VH | 1582 | |
| EGFR | VH | 1583 | |
| EGFR | VH | 1584 | |
| EGFR | VH | 1585 | |
| EGFR | VH | 1586 | |
| EGFR | VH | 1587 | |
| EGFR | VH | 1588 | |
| EGFR | VH | 1589 | |
| EGFR | VH | 1590 | |
| EGFR | VH | 1591 | |
| EGFR | VH | 1592 | |
| EGFR | VH | 1593 | |
| EGFR | VH | 1594 | |
| EGFR | VH | 1595 | |
| EGFR | VH | 1596 | |
| EGFR | VH | 1597 | |
| EGFR | VH | 1598 | |
| EGFR | VH | 1599 | |
| EGFR | VH | 1600 | |
| EGFR | VH | 1601 | |
| EGFR | VH | 1602 | |
| EGFR | VH | 1603 | |
| EGFR | VH | 1604 | |
| EGFR | VH | 1605 | |
| EGFR | VH | 1606 | |
| EGFR | VH | 1607 | |
| EGFR | VH | 1608 | |
| EGFR | VH | 1609 | |
| EGFR | VH | 1610 | |
| EGFR | VH | 1611 | |
| EGFR | VH | 1612 | |
| EGFR | VH | 1613 | |
| EGFR | VH | 1614 | |
| EGFR | VH | 1615 | |
| EGFR | VH | 1616 | |
| EGFR | VH | 1617 | |
| EGFR | VH | 1618 | |
| EGFR | VH | 1619 | |
| EGFR | VH | 1620 | |
| EGFR | VH | 1621 | |
| EGFR | VH | 1622 | |
| EGFR | VH | 1623 | |
| EGFR | VH | 1624 | |
| EGFR | VH | 1625 | |
| EGFR | VH | 1626 | |
| EGFR | VH | 1627 | |
| EGFR | VH | 1628 | |
| EGFR | VH | 1629 | |
| EGFR | VH | 1630 | |
| EGFR | VH | 1631 | |
| EGFR | VH | 1632 | |
| EGFR | VH | 1633 | |
| EGFR | VH | 1634 | |
| EGFR | VH | 1635 | |
| EGFR | VH | 1636 | |
| EGFR | VH | 1637 | |
| EGFR | VH | 1638 | |
| EGFR | VH | 1639 | |
| EGFR | VH | 1640 | |
| EGFR | VH | 1641 | |
| EGFR | VH | 1642 | |
| EGFR | VH | 1643 | |
| EGFR | VH | 1644 | |
| EGFR | VH | 1645 | |
| EGFR | VH | 1646 | |
| EGFR | VH | 1647 | |
| EGFR | VH | 1648 | |
| EGFR | VH | 1649 | |
| EGFR | VH | 1650 | |
| EGFR | VH | 1651 | |
| EGFR | VH | 1652 | |
| EGFR | VH | 1653 | |
| EGFR | VH | 1654 | |
| EGFR | VH | 1655 | |

TABLE 10-continued

Variable Heavy and Light Chain Sequences

| Target | Antibody chain | SEQ ID NO | Source |
|---|---|---|---|
| EGFR | VH | 1656 | |
| EGFR | VH | 1657 | |
| EGFR | VH | 1658 | |
| EGFR | VH | 1659 | |
| EGFR | VH | 1660 | |
| EGFR | VH | 1661 | |
| EGFR | VH | 1662 | |
| EGFR | VH | 1663 | |
| EGFR | VH | 1664 | |
| EGFR | VH | 1665 | |
| EGFR | VH | 1666 | |
| EGFR | VH | 1667 | |
| EGFR | VH | 1668 | |
| EGFR | VH | 1669 | |
| EGFR | VH | 1670 | |
| EGFR | VH | 1671 | |
| EGFR | VH | 1672 | |
| EGFR | VH | 1673 | |
| EGFR | VH | 1674 | |
| EGFR | VH | 1675 | |
| EGFR | VH | 1676 | |
| EGFR | VH | 1677 | |
| EGFR | VH | 1678 | |
| EGFR | VH | 1679 | |
| EGFR | VH | 1680 | |
| EGFR | VH | 1681 | |
| EGFR | VH | 1682 | |
| EGFR | VH | 1683 | |
| EGFR | VH | 1684 | |
| EGFR | VH | 1685 | |
| EGFR | VH | 1686 | |
| EGFR | VH | 1687 | |
| EGFR | VH | 1688 | |
| EGFR | VH | 1689 | |
| EGFR | VH | 1690 | |
| EGFR | VH | 1691 | |
| EGFR | VH | 1692 | |
| EGFR | VH | 1693 | |
| EGFR | VH | 1694 | |
| EGFR | VH | 1695 | |
| EGFR | VH | 1696 | |
| EGFR | VH | 1697 | |
| EGFR | VH | 1698 | |
| EGFR | VH | 1699 | |
| EGFR | VH | 1700 | |
| EGFR | VH | 1701 | |
| EGFR | VH | 1702 | |
| EGFR | VH | 1703 | |
| EGFR | VH | 1704 | |
| EGFR | VH | 1705 | |
| EGFR | VH | 1706 | |
| EGFR | VH | 1707 | |
| EGFR | VH | 1708 | |
| EGFR | VH | 1709 | |
| EGFR | VH | 1710 | |
| EGFR | VH | 1711 | |
| EGFR | VH | 1712 | |
| EGFR | VH | 1713 | |
| EGFR | VH | 1714 | |
| EGFR | VH | 1715 | |
| EGFR | VH | 1716 | |
| EGFR | VH | 1717 | |
| EGFR | VH | 1718 | |
| EGFR | VH | 1719 | |
| EGFR | VH | 1720 | |
| EGFR | VH | 1721 | |
| EGFR | VH | 1722 | |
| EGFR | VH | 1723 | |
| EGFR | VH | 1724 | |
| EGFR | VH | 1725 | |
| EGFR | VH | 1726 | |
| EGFR | VH | 1727 | |
| EGFR | VH | 1728 | |
| EGFR | VH | 1729 | |
| EGFR | VH | 1730 | |

TABLE 10-continued

| Variable Heavy and Light Chain Sequences | | | |
|---|---|---|---|
| Target | Antibody chain | SEQ ID NO | Source |
| EGFR | VH | 1731 | |
| EGFR | VH | 1732 | |
| EGFR | VH | 1733 | |
| EGFR | VH | 1734 | |
| EGFR | VH | 1735 | |
| EGFR | VH | 1736 | |
| EGFR | VH | 1737 | |
| EGFR | VH | 1738 | |
| EGFR | VH | 1739 | |
| EGFR | VH | 1740 | |
| EGFR | VH | 1741 | |
| EGFR | VH | 1742 | |
| EGFR | VH | 1743 | |
| EGFR | VH | 1744 | |
| EGFR | VH | 1745 | |
| EGFR | VH | 1746 | |
| EGFR | VH | 1747 | |
| EGFR | VH | 1748 | |
| EGFR | VH | 1749 | |
| EGFR | VH | 1750 | |
| EGFR | VH | 1751 | |
| EGFR | VH | 1752 | |
| EGFR | VH | 1753 | |
| EGFR | VH | 1754 | |
| EGFR | VH | 1755 | |
| EGFR | VH | 1756 | |
| EGFR | VH | 1757 | |
| EGFR | VH | 1758 | |
| EGFR | VH | 1759 | |
| EGFR | VH | 1760 | |
| EGFR | VH | 1761 | |
| EGFR | VH | 1762 | |
| EGFR | VH | 1763 | |
| EGFR | VH | 1764 | |
| EGFR | VH | 1765 | |
| EGFR | VH | 1766 | |
| EGFR | VH | 1767 | |
| EGFR | VH | 1768 | |
| EGFR | VH | 1769 | |
| EGFR | VH | 1770 | |
| EGFR | VH | 1771 | |
| EGFR | VH | 1772 | |
| EGFR | VH | 1773 | |
| EGFR | VH | 1774 | |
| EGFR | VH | 1775 | |
| EGFR | VH | 1776 | |
| EGFR | VH | 1777 | |
| EGFR | VH | 1778 | |
| EGFR | VH | 1779 | |
| EGFR | VH | 1780 | |
| EGFR | VH | 1781 | |
| EGFR | VH | 1782 | |
| EGFR | VH | 1783 | |
| EGFR | VH | 1784 | |
| EGFR | VH | 1785 | |
| EGFR | VH | 1786 | |
| EGFR | VH | 1787 | |
| EGFR | VH | 1788 | |
| EGFR | VH | 1789 | |
| EGFR | VH | 1790 | |
| EGFR | VH | 1791 | |
| EGFR | VH | 1792 | |
| EGFR | VH | 1793 | |
| EGFR | VH | 1794 | |
| EGFR | VH | 1795 | |
| EGFR | VH | 1796 | |
| EGFR | VH | 1797 | |
| EGFR | VH | 1798 | |
| EGFR | VH | 1799 | |
| EGFR | VH | 1800 | |
| EGFR | VH | 1801 | |
| EGFR | VH | 1802 | |
| EGFR | VH | 1803 | |
| EGFR | VH | 1804 | |
| EGFR | VH | 1805 | |

TABLE 10-continued

Variable Heavy and Light Chain Sequences

| Target | Antibody chain | SEQ ID NO | Source |
|---|---|---|---|
| EGFR | VH | 1806 | |
| EGFR | VH | 1807 | |
| EGFR | VH | 1808 | |
| EGFR | VH | 1809 | |
| EGFR | VH | 1810 | |
| EGFR | VH | 1811 | |
| EGFR | VH | 1812 | |
| EGFR | VH | 1813 | |
| EGFR | VH | 1814 | |
| EGFR | VH | 1815 | |
| EGFR | VH | 1816 | |
| EGFR | VH | 1817 | |
| EGFR | VH | 1818 | |
| EGFR | VH | 1819 | |
| EGFR | VH | 1820 | |
| EGFR | VH | 1821 | |
| EGFR | VH | 1822 | |
| EGFR | VH | 1823 | |
| EGFR | VH | 1824 | |
| EGFR | VH | 1825 | |
| EGFR | VH | 1826 | |
| EGFR | VH | 1827 | |
| EGFR | VH | 1828 | |
| EGFR | VH | 1829 | |
| EGFR | VH | 1830 | |
| EGFR | VH | 1831 | |
| EGFR | VH | 1832 | |
| EGFR | VH | 1833 | |
| EGFR | VH | 1834 | |
| EGFR | VH | 1835 | |
| EGFR | VH | 1836 | |
| EGFR | VH | 1837 | |
| EGFR | VH | 1838 | |
| EGFR | VH | 1839 | |
| EGFR | VH | 1840 | |
| EGFR | VH | 1841 | |
| EGFR | VH | 1842 | |
| EGFR | VH | 1843 | |
| EGFR | VH | 1844 | |
| EGFR | VH | 1845 | |
| EGFR | VH | 1846 | |
| EGFR | VH | 1847 | |
| EGFR | VH | 1848 | |
| EGFR | VH | 1849 | |
| EGFR | VH | 1850 | |
| EGFR | VH | 1851 | |
| EGFR | VH | 1852 | |
| EGFR | VH | 1853 | |
| EGFR | VH | 1854 | |
| EGFR | VH | 1855 | |
| EGFR | VH | 1856 | |
| EGFR | VH | 1857 | |
| EGFR | VH | 1858 | |
| EGFR | VH | 1859 | |
| EGFR | VH | 1860 | |
| EGFR | VH | 1861 | |
| EGFR | VH | 1862 | |
| EGFR | VH | 1863 | |
| EGFR | VH | 1864 | |
| EGFR | VH | 1865 | |
| EGFR | VH | 1866 | |
| EGFR | VH | 1867 | |
| EGFR | VH | 1868 | |
| EGFR | VH | 1869 | |
| EGFR | VH | 1870 | |
| EGFR | VH | 1871 | |
| EGFR | VH | 1872 | |
| EGFR | VH | 1873 | |
| EGFR | VH | 1874 | |
| EGFR | VH | 1875 | |
| EGFR | VH | 1876 | |
| EGFR | VH | 1877 | |
| EGFR | VH | 1878 | |
| EGFR | VH | 1879 | |
| EGFR | VH | 1880 | |

TABLE 10-continued

Variable Heavy and Light Chain Sequences

| Target | Antibody chain | SEQ ID NO | Source |
|---|---|---|---|
| EGFR | VH | 1881 | |
| EGFR | VH | 1882 | |
| EGFR | VH | 1883 | |
| EGFR | VH | 1884 | |
| EGFR | VH | 1885 | |
| EGFR | VH | 1886 | |
| EGFR | VH | 1887 | |
| EGFR | VH | 1888 | |
| EGFR | VH | 1889 | |
| EGFR | VH | 1890 | |
| EGFR | VH | 1891 | |
| EGFR | VH | 1892 | |
| EGFR | VH | 1893 | |
| EGFR | VH | 1894 | |
| EGFR | VH | 1895 | |
| EGFR | VH | 1896 | |
| EGFR | VH | 1897 | |
| EGFR | VH | 1898 | |
| EGFR | VH | 1899 | |
| EGFR | VH | 1900 | |
| EGFR | VH | 1901 | |
| EGFR | VH | 1902 | |
| EGFR | VH | 1903 | |
| EGFR | VH | 1904 | |
| EGFR | VH | 1905 | |
| EGFR | VH | 1906 | |
| EGFR | VH | 1907 | |
| EGFR | VH | 1908 | |
| EGFR | VH | 1909 | |
| EGFR | VH | 1910 | |
| EGFR | VH | 1911 | |
| EGFR | VH | 1912 | |
| EGFR | VH | 1913 | |
| EGFR | VH | 1914 | |
| EGFR | VH | 1915 | |
| EGFR | VH | 1916 | |
| EGFR | VH | 1917 | |
| EGFR | VH | 1918 | |
| EGFR | VH | 1919 | |
| EGFR | VH | 1920 | |
| EGFR | VH | 1921 | |
| EGFR | VH | 1922 | |
| EGFR | VH | 1923 | |
| EGFR | VH | 1924 | |
| EGFR | VH | 1925 | |
| EGFR | VH | 1926 | |
| EGFR | VH | 1927 | |
| EGFR | VH | 1928 | |
| EGFR | VH | 1929 | |
| EGFR | VH | 1930 | |
| EGFR | VH | 1931 | |
| EGFR | VH | 1932 | |
| EGFR | VH | 1933 | |
| EGFR | VH | 1934 | |
| EGFR | VH | 1935 | |
| EGFR | VH | 1936 | |
| EGFR | VH | 1937 | |
| EGFR | VH | 1938 | |
| EGFR | VH | 1939 | |
| EGFR | VH | 1940 | |
| EGFR | VH | 1941 | |
| EGFR | VH | 1942 | |
| EGFR | VH | 1943 | |
| EGFR | VH | 1944 | |
| EGFR | VH | 1945 | |
| EGFR | VH | 1946 | |
| EGFR | VH | 1947 | |
| EGFR | VH | 1948 | |
| EGFR | VH | 1949 | |
| EGFR | VH | 1950 | |
| EGFR | VH | 1951 | |
| EGFR | VH | 1952 | |
| EGFR | VH | 1953 | |
| EGFR | VH | 1954 | |
| EGFR | VH | 1955 | |

TABLE 10-continued

Variable Heavy and Light Chain Sequences

| Target | Antibody chain | SEQ ID NO | Source |
|---|---|---|---|
| EGFR | VH | 1956 | |
| EGFR | VH | 1957 | |
| EGFR | VH | 1958 | |
| EGFR | VH | 1959 | |
| EGFR | VH | 1960 | |
| EGFR | VH | 1961 | |
| EGFR | VH | 1962 | |
| EGFR | VH | 1963 | |
| EGFR | VH | 1964 | |
| EGFR | VH | 1965 | |
| EGFR | VH | 1966 | |
| EGFR | VH | 1967 | |
| EGFR | VH | 1968 | |
| EGFR | VH | 1969 | |
| EGFR | VH | 1970 | |
| EGFR | VH | 1971 | |
| EGFR | VH | 1972 | |
| EGFR | VH | 1973 | |
| EGFR | VH | 1974 | |
| EGFR | VH | 1975 | |
| EGFR | VH | 1976 | |
| EGFR | VH | 1977 | |
| EGFR | VH | 1978 | |
| EGFR | VH | 1979 | |
| EGFR | VH | 1980 | |
| EGFR | VH | 1981 | |
| EGFR | VH | 1982 | |
| EGFR | VH | 1983 | |
| EGFR | VH | 1984 | |
| EGFR | VH | 1985 | |
| EGFR | VH | 1986 | |
| EGFR | VH | 1987 | |
| EGFR | VH | 1988 | |
| EGFR | VH | 1989 | |
| EGFR | VH | 1990 | |
| EGFR | VH | 1991 | |
| EGFR | VH | 1992 | |
| EGFR | VH | 1993 | |
| EGFR | VH | 1994 | |
| EGFR | VH | 1995 | |
| EGFR | VH | 1996 | |
| EGFR | VH | 1997 | |
| EGFR | VH | 1998 | |
| EGFR | VH | 1999 | |
| EGFR | VH | 2000 | |
| EGFR | VH | 2001 | |
| EGFR | VH | 2002 | |
| EGFR | VH | 2003 | |
| EGFR | VH | 2004 | |
| EGFR | VH | 2005 | |
| EGFR | VH | 2006 | |
| EGFR | VH | 2007 | |
| EGFR | VH | 2008 | |
| EGFR | VH | 2009 | |
| EGFR | VH | 2010 | |
| EGFR | VH | 2011 | |
| EGFR | VH | 2012 | |
| EGFR | VH | 2013 | |
| EGFR | VH | 2014 | |
| EGFR | VH | 2015 | |
| EGFR | VH | 2016 | |
| EGFR | VH | 2017 | |
| EGFR | VH | 2018 | |
| EGFR | VH | 2019 | |
| EGFR | VH | 2020 | |
| EGFR | VH | 2021 | |
| EGFR | VH | 2022 | |
| EGFR | VH | 2023 | |
| EGFR | VH | 2024 | |
| EGFR | VH | 2025 | |
| EGFR | VH | 2026 | |
| EGFR | VH | 2027 | |
| EGFR | VH | 2028 | |
| EGFR | VH | 2029 | |
| EGFR | VH | 2030 | |

TABLE 10-continued

Variable Heavy and Light Chain Sequences

| Target | Antibody chain | SEQ ID NO | Source |
|---|---|---|---|
| EGFR | VH | 2031 | |
| EGFR | VH | 2032 | |
| EGFR | VH | 2033 | |
| EGFR | VH | 2034 | |
| EGFR | VH | 2035 | |
| EGFR | VH | 2036 | |
| EGFR | VH | 2037 | |
| EGFR | VH | 2038 | |
| EGFR | VH | 2039 | |
| EGFR | VH | 2040 | |
| EGFR | VH | 2041 | |
| EGFR | VH | 2042 | |
| EGFR | VH | 2043 | |
| EGFR | VH | 2044 | |
| EGFR | VH | 2045 | |
| EGFR | VH | 2046 | |
| EGFR | VH | 2047 | |
| EGFR | VH | 2048 | |
| EGFR | VH | 2049 | |
| EGFR | VH | 2050 | |
| EGFR | VH | 2051 | |
| EGFR | VH | 2052 | |
| EGFR | VH | 2053 | |
| EGFR | VH | 2054 | |
| EGFR | VH | 2055 | |
| EGFR | VH | 2056 | |
| EGFR | VH | 2057 | |
| EGFR | VH | 2058 | |
| EGFR | VH | 2059 | |
| EGFR | VH | 2060 | |
| EGFR | VH | 2061 | |
| EGFR | VH | 2062 | |
| EGFR | VH | 2063 | |
| EGFR | VH | 2064 | |
| EGFR | VH | 2065 | |
| EGFR | VH | 2066 | |
| EGFR | VH | 2067 | |
| EGFR | VH | 2068 | |
| EGFR | VH | 2069 | |
| EGFR | VH | 2070 | |
| EGFR | VH | 2071 | |
| EGFR | VH | 2072 | |
| EGFR | VH | 2073 | |
| EGFR | VH | 2074 | |
| EGFR | VH | 2075 | |
| EGFR | VH | 2076 | |
| EGFR | VH | 2077 | |
| EGFR | VH | 2078 | |
| EGFR | VH | 2079 | |
| EGFR | VH | 2080 | |
| EGFR | VH | 2081 | |
| EGFR | VH | 2082 | |
| EGFR | VH | 2083 | |
| EGFR | VH | 2084 | |
| EGFR | VH | 2085 | |
| EGFR | VH | 2086 | |
| EGFR | VH | 2087 | |
| EGFR | VH | 2088 | |
| EGFR | VH | 2089 | |
| EGFR | VH | 2090 | |
| EGFR | VH | 2091 | |
| EGFR | VH | 2092 | |
| EGFR | VH | 2093 | |
| EGFR | VH | 2094 | |
| EGFR | VH | 2095 | |
| EGFR | VH | 2096 | |
| EGFR | VH | 2097 | |
| EGFR | VH | 2098 | |
| EGFR | VH | 2099 | |
| EGFR | VH | 2100 | |
| EGFR | VH | 2101 | |
| EGFR | VH | 2102 | |
| EGFR | VH | 2103 | |
| EGFR | VH | 2104 | |
| EGFR | VH | 2105 | |

TABLE 10-continued

Variable Heavy and Light Chain Sequences

| Target | Antibody chain | SEQ ID NO | Source |
|---|---|---|---|
| EGFR | VH | 2106 | |
| EGFR | VH | 2107 | |
| EGFR | VH | 2108 | |
| EGFR | VH | 2109 | |
| EGFR | VH | 2110 | |
| EGFR | VH | 2111 | |
| EGFR | VH | 2112 | |
| EGFR | VH | 2113 | |
| EGFR | VH | 2114 | |
| EGFR | VH | 2115 | |
| EGFR | VH | 2116 | |
| EGFR | VH | 2117 | |
| EGFR | VH | 2118 | |
| EGFR | VH | 2119 | |
| EGFR | VH | 2120 | |
| EGFR | VH | 2121 | |
| EGFR | VH | 2122 | |
| EGFR(Cetuximab) | VH | 2123 | |
| EGFR(Cetuximab) | VH | 2124 | |
| EGFR(EGFRvIII) | VH | 2125 | |
| EGFR(EGFRvIII) | VH | 2126 | |
| EGFR(EGFRvIII) | VH | 2127 | |
| EGFR(EGFRvIII) | VH | 2128 | |
| EGFR(EGFRvIII) | VH | 2129 | |
| EGFR(EGFRvIII) | VH | 2130 | |
| EGFR(EGFRvIII) | VH | 2131 | |
| EGFR(EGFRvIII) | VH | 2132 | |
| EGFR(EGFRvIII) | VH | 2133 | |
| EGFR(EGFRvIII) | VH | 2134 | |
| EGFR(EGFRvIII) | VH | 2135 | |
| EGFR(EGFRvIII) | VH | 2136 | |
| EGFR(EGFRvIII) | VH | 2137 | |
| EGFR(EGFRvIII) | VH | 2138 | |
| EGFR(EGFRvIII) | VH | 2139 | |
| EGFR(EGFRvIII) | VH | 2140 | |
| EGFR(EGFRvIII) | VH | 2141 | |
| EGFR(EGFRvIII) | VH | 2142 | |
| EGFR(EGFRvIII) | VH | 2143 | |
| EGFR(EGFRvIII) | VH | 2144 | |
| EGFR(EGFRvIII) | VH | 2145 | |
| EGFR(EGFRvIII) | VH | 2146 | |
| EGFRvIII | VH | 2147 | SEQ ID NO. 13 in WO2016016341 |
| EGFRvIII | VH | 2148 | SEQ ID NO: 24 in WO2016168773A3 |
| EGFRvIII | VH | 2149 | SEQ ID NO. 34 in US20160304615 |
| EGFRvIII | VH | 2150 | SEQ ID NO: 2 in US20160200819A1 |
| Endoglin | VH | 2151 | SEQ ID NO. 41 in US20160009811 |
| Endoglin | VH | 2152 | SEQ ID NO. 42 in US20160009811 |
| Endoglin | VH | 2153 | SEQ ID NO. 43 in US20160009811 |
| Endoglin | VH | 2154 | SEQ ID NO. 71 in US20160009811 |
| Endoglin | VH | 2155 | SEQ ID NO. 73 in US20160009811 |
| Endoglin | VH | 2156 | SEQ ID NO. 75 in US20160009811 |
| Endoglin | VH | 2157 | SEQ ID NO. 88 in US20160009811 |
| Endoglin | VH | 2158 | SEQ ID NO. 89 in US20160009811 |
| Endoglin | VH | 2159 | SEQ ID NO. 90 in US20160009811 |
| Endoglin | VH | 2160 | SEQ ID NO. 91 in US20160009811 |
| Endoglin | VH | 2161 | SEQ ID NO. 92 in US20160009811 |
| EphA2receptor | VH | 2162 | US20150274824 SEQ ID NO: 20 |
| EphA2receptor | VH | 2163 | US20150274824 SEQ ID NO: 22 |
| EphA2receptor | VH | 2164 | US20150274824 SEQ ID NO: 24 |
| EphA2receptor | VH | 2165 | US20150274824 SEQ ID NO: 32 |
| EphA2receptor | VH | 2166 | US20150274824 SEQ ID NO: 34 |
| EphA2receptor | VH | 2167 | US20150274824 SEQ ID NO: 36 |
| EphA2receptor | VH | 2168 | US20150274824 SEQ ID NO: 37 |
| EphA2receptor | VH | 2169 | US20150274824 SEQ ID NO: 38 |
| EphA2receptor | VH | 2170 | US20150274824 SEQ ID NO: 40 |
| EphA2receptor | VH | 2171 | US20150274824 SEQ ID NO: 42 |
| EphA2receptor | VH | 2172 | US20150274824 SEQ ID NO: 43 |
| EphA2receptor | VH | 2173 | US20150274824 SEQ ID NO: 45 |
| EphA2receptor | VH | 2174 | US20150274824 SEQ ID NO: 74 |
| EphA2receptor | VH | 2175 | US20150274824 SEQ ID NO: 76 |
| ERBB2 | VH | 2176 | US20110129464 SEQ ID NO: 2 |
| ERBB2 | VH | 2177 | US20110129464 SEQ ID NO: 4 |
| ERBB2 | VH | 2178 | US20130089544 SEQ ID NO: 10 |
| ERBB2 | VH | 2179 | US20130089544 SEQ ID NO: 2 |
| ERBB2 | VH | 2180 | US20130089544 SEQ ID NO: 26 |

TABLE 10-continued

Variable Heavy and Light Chain Sequences

| Target | Antibody chain | SEQ ID NO | Source |
|---|---|---|---|
| ERBB2 | VH | 2181 | US20130089544 SEQ ID NO: 30 |
| ERBB2 | VH | 2182 | US20130089544 SEQ ID NO: 38 |
| ERBB2 | VH | 2183 | US20130089544 SEQ ID NO: 4 |
| ERBB2 | VH | 2184 | US20130089544 SEQ ID NO: 40 |
| ERBB2 | VH | 2185 | US20130089544 SEQ ID NO: 42 |
| ERBB2 | VH | 2186 | US20130089544 SEQ ID NO: 52 |
| ERBB2 | VH | 2187 | US20130089544 SEQ ID NO: 54 |
| ERBB2 | VH | 2188 | US20130089544 SEQ ID NO: 56 |
| ERBB2 | VH | 2189 | US20130089544 SEQ ID NO: 57 |
| ERBB2 | VH | 2190 | US20130089544 SEQ ID NO: 58 |
| ERBB2 | VH | 2191 | US20130089544 SEQ ID NO: 6 |
| ERBB2 | VH | 2192 | US20130266564 SEQ ID NO: 8 |
| ERBB2 | VH | 2193 | US20150104443 SEQ ID NO: 1 |
| FactorD | VH | 2194 | SEQ ID NO. 17 in US20160017052 |
| FactorD | VH | 2195 | SEQ ID NO. 20 in US20160017052 |
| FactorD | VH | 2196 | SEQ ID NO. 27 in US20160017052 |
| FactorD | VH | 2197 | SEQ ID NO. 29 in US20160017052 |
| FactorD | VH | 2198 | SEQ ID NO. 30 in US20160017052 |
| FactorD | VH | 2199 | SEQ ID NO. 31 in US20160017052 |
| FactorD | VH | 2200 | SEQ ID NO. 32 in US20160017052 |
| FactorD | VH | 2201 | SEQ ID NO. 33 in US20160017052 |
| FactorD | VH | 2202 | SEQ ID NO. 4 in US20160017052 |
| FactorXII | VH | 2203 | SEQ ID NO. 15 in WO2014089493 |
| FAP | VH | 2204 | SEQ ID NO. 1 in WO2015118030 |
| FAP | VH | 2205 | SEQ ID NO. 5 in WO2015118030 |
| FAP | VH | 2206 | SEQ ID NO. 170 in WO2016120216 |
| FAP | VH | 2207 | SEQ ID NO. 172 in WO2016120216 |
| FcRL5(FcReceptorLike5) | VH | 2208 | SEQ ID NO: 12 WO2016090337 |
| FcRL5(FcReceptorLike5) | VH | 2209 | SEQ ID NO: 16 WO2016090337 |
| FcRL5(FcReceptorLike5) | VH | 2210 | SEQ ID NO: 20 WO2016090337 |
| FcRL5(FcReceptorLike5) | VH | 2211 | SEQ ID NO: 24 WO2016090337 |
| FcRL5(FcReceptorLike5) | VH | 2212 | SEQ ID NO: 28 WO2016090337 |
| FcRL5(FcReceptorLike5) | VH | 2213 | SEQ ID NO: 32 WO2016090337 |
| FcRL5(FcReceptorLike5) | VH | 2214 | SEQ ID NO: 36 WO2016090337 |
| FcRL5(FcReceptorLike5) | VH | 2215 | SEQ ID NO: 4 WO2016090337 |
| FcRL5(FcReceptorLike5) | VH | 2216 | SEQ ID NO: 40 WO2016090337 |
| FcRL5(FcReceptorLike5) | VH | 2217 | SEQ ID NO: 44 WO2016090337 |
| FcRL5(FcReceptorLike5) | VH | 2218 | SEQ ID NO: 48 WO2016090337 |
| FcRL5(FcReceptorLike5) | VH | 2219 | SEQ ID NO: 8 WO2016090337 |
| FcRL5(FcReceptorLike5) | VH | 2220 | SEQ ID NO: 915 WO2016090337 |
| FcRL5(FcReceptorLike5) | VH | 2221 | SEQ ID NO: 919 WO2016090337 |
| FGFR3 | VH | 2222 | SEQ ID NO. 132 in U.S. Pat. No. 9,499,623 |
| FGFR3 | VH | 2223 | SEQ ID NO. 134 in U.S. Pat. No. 9,499,623 |
| FGFR3 | VH | 2224 | SEQ ID NO. 136 in U.S. Pat. No. 9,499,623 |
| FGFR4 | VH | 2225 | SEQ ID NO. 7 in US20160237157 |
| Frizzled Receptor | VH | 2226 | SEQ ID NO. 10 in WO2010037041 |
| GAH | VH | 2227 | SEQ ID NO 7 in US20060057147A1 |
| GCC1 | VH | 2228 | SEQ ID NO. 1 in US20160030595A1 |
| GD2 | VH | 2229 | SEQ ID NO. 10 in WO2015132604 |
| GD2 | VH | 2230 | SEQ ID NO. 3 in US20130216528 |
| GD2 | VH | 2231 | SEQ ID NO. 4 in US20130216528 |
| GD2 | VH | 2232 | SEQ ID NO. 6 in US20130216528 |
| GD2 | VH | 2233 | SEQ ID NO. 8 in US20130216528 |
| GD2 | VH | 2234 | SEQ ID NO. 9 in WO2015132604 |
| GD3 | VH | 2235 | SEQ ID NO: 11 in WO2016185035A1 |
| GD3 | VH | 2236 | SEQ ID NO: 13 in WO2016185035A1 |
| GD3 | VH | 2237 | SEQ ID NO: 15 in WO2016185035A1 |
| GD3 | VH | 2238 | SEQ ID NO: 17 in WO2016185035A1 |
| Glyco epitope and ErbBB I Specific | VH | 2239 | SEQ ID No. 7 in WO2012007167A1 |
| Glyco epitope and ErbBBI Specific | VH | 2240 | SEQ ID No. 9 in WO2012007167A1 |
| GM2 | VH | 2241 | US20090028877 SEQ ID NO: 20 |
| GM2 | VH | 2242 | US20090028877 SEQ ID NO: 22 |
| GM2 | VH | 2243 | US20090028877 SEQ ID NO: 23 |
| GM2 | VH | 2244 | US20090028877 SEQ ID NO: 26 |
| GM2 | VH | 2245 | US20090028877 SEQ ID NO: 27 |
| GM2 | VH | 2246 | US20090028877 SEQ ID NO: 28 |
| GM2 | VH | 2247 | US20090028877 SEQ ID NO: 29 |
| GM2 | VH | 2248 | US20090028877 SEQ ID NO: 30 |
| GPC3 | VH | 2249 | SEQ ID NO: 10 in US20160208015A1 |
| GPC3 | VH | 2250 | SEQ ID NO: 14 in US20160208015A1 |
| GPC3 | VH | 2251 | SEQ ID NO: 2 in US20160208015A1 |
| GPC3 | VH | 2252 | SEQ ID NO: 3 in US20160208015A1 |
| GPC3 | VH | 2253 | SEQ ID NO: 4 in US20160208015A1 |

TABLE 10-continued

Variable Heavy and Light Chain Sequences

| Target | Antibody chain | SEQ ID NO | Source |
|---|---|---|---|
| GPC3 | VH | 2254 | SEQ ID NO: 5 in US20160208015A1 |
| GPC3 | VH | 2255 | SEQ ID NO: 6 in US20160208015A1 |
| GPC3 | VH | 2256 | SEQ ID NO: 7 in US20160208015A1 |
| GPC3 | VH | 2257 | SEQ ID NO: 8 in US20160208015A1 |
| GPC3 | VH | 2258 | SEQ ID NO: 9 in US20160208015A1 |
| GPRC5D | VH | 2259 | SEQ ID NO. 13 in WO2016090312 |
| GPRC5D | VH | 2260 | SEQ ID NO. 17 in WO2016090312 |
| GPRC5D | VH | 2261 | SEQ ID NO. 21 in WO2016090312 |
| GPRC5D | VH | 2262 | SEQ ID NO. 25 in WO2016090312 |
| GPRC5D | VH | 2263 | SEQ ID NO. 29 in WO2016090312 |
| GPRC5D | VH | 2264 | SEQ ID NO. 314 in WO2016090312 |
| GPRC5D | VH | 2265 | SEQ ID NO. 326 in WO2016090312 |
| GPRC5D | VH | 2266 | SEQ ID NO. 33 in WO2016090312 |
| GPRC5D | VH | 2267 | SEQ ID NO. 338 in WO2016090312 |
| GPRC5D | VH | 2268 | SEQ ID NO. 350 in WO2016090312 |
| GPRC5D | VH | 2269 | SEQ ID NO. 362 in WO2016090312 |
| GPRC5D | VH | 2270 | SEQ ID NO. 37 in WO2016090312 |
| GPRC5D | VH | 2271 | SEQ ID NO. 374 in WO2016090312 |
| GPRC5D | VH | 2272 | SEQ ID NO. 386 in WO2016090312 |
| GPRC5D | VH | 2273 | SEQ ID NO. 41 in WO2016090312 |
| GPRC5D | VH | 2274 | SEQ ID NO. 45 in WO2016090312 |
| GPRC5D | VH | 2275 | SEQ ID NO. 49 in WO2016090312 |
| GPRC5D | VH | 2276 | SEQ ID NO. 5 in WO2016090312 |
| GPRC5D | VH | 2277 | SEQ ID NO. 53 in WO2016090312 |
| GPRC5D | VH | 2278 | SEQ ID NO. 57 in WO2016090312 |
| GPRC5D | VH | 2279 | SEQ ID NO. 61 in WO2016090312 |
| GPRC5D | VH | 2280 | SEQ ID NO. 65 in WO2016090312 |
| GPRC5D | VH | 2281 | SEQ ID NO. 69 in WO2016090312 |
| GPRC5D | VH | 2282 | SEQ ID NO. 73 in WO2016090312 |
| GPRC5D | VH | 2283 | SEQ ID NO. 77 in WO2016090312 |
| GPRC5D | VH | 2284 | SEQ ID NO. 81 in WO2016090312 |
| GPRC5D | VH | 2285 | SEQ ID NO. 85 in WO2016090312 |
| GPRC5D | VH | 2286 | SEQ ID NO. 89 in WO2016090312 |
| GPRC5D | VH | 2287 | SEQ ID NO. 93 in WO2016090312 |
| GPRC5D | VH | 2288 | SEQ ID NO. 1 in WO2016090312 |
| GPRC5D | VH | 2289 | SEQ ID NO. 9 in WO2016090312 |
| Her1/her3 | VH | 2290 | SEQ ID NO: 8 of WO2016073629 |
| Her2 | VH | 2291 | SEQ ID NO: 141 in WO2016054555A2 |
| Her2 | VH | 2292 | SEQ ID NO: 262 in WO2016168773A3 |
| Her2 | VH | 2293 | SEQ ID NO: 264 in WO2016168773A3 |
| Her2 | VH | 2294 | SEQ ID NO: 266 in WO2016168773A3 |
| Her2 | VH | 2295 | SEQ ID NO: 268 in WO2016168773A3 |
| Her2 | VH | 2296 | SEQ ID NO: 270 in WO2016168773A3 |
| HER2 | VH | 2297 | SEQ ID NO. 11 in U.S. Pat. No. 9,518,118 |
| HER2 | VH | 2298 | SEQ ID NO: 62 in US20160333114A1 |
| HLAG | VH | 2299 | SEQ ID NO. 10 in WO2016160622A2 |
| HLAG | VH | 2300 | SEQ ID NO. 8 in WO2016160622A2 |
| HSP70 | VH | 2301 | SEQ ID NO. 11 in WO2016120217 |
| HSP70 | VH | 2302 | SEQ ID NO. 12 in WO2016120217 |
| humanCD79b | VH | 2303 | SEQ ID NO. 27 in WO2016112870 |
| humanCD79b | VH | 2304 | SEQ ID NO. 29 in WO2016112870 |
| Human chorionic gonadotropin | VH | 2305 | SEQ ID NO. 2 in WO2007019541 |
| Human chorionic gonadotropin | VH | 2306 | SEQ ID NO. 4 in WO2007019541 |
| Human chorionic gonadotropin | VH | 2307 | SEQ ID NO. 6 in WO2007019541 |
| Human collagen VII | VH | 2308 | SEQ ID NO. 31 in WO2016112870 |
| humanERBB3 | VH | 2309 | SEQ ID NO: 19 in WO2013052745 |
| humanERBB3 | VH | 2310 | SEQ ID NO: 29 in WO2013052745 |
| humanERBB3 | VH | 2311 | SEQ ID NO: 38 in WO2013052745 |
| humanERBB3 | VH | 2312 | SEQ ID NO: 45 in WO2013052745 |
| humanERBB3 | VH | 2313 | SEQ ID NO: 55 in WO2013052745 |
| humanERBB3 | VH | 2314 | SEQ ID NO: 61 in WO2013052745 |
| humanERBB3 | VH | 2315 | SEQ ID NO: 9 in WO2013052745 |
| ICOS | VH | 2316 | SEQ ID NO. 15 in US20160215059 |
| ICOS | VH | 2317 | SEQ ID NO. 16 in US20160215059 |
| ICOS | VH | 2318 | SEQ ID NO. 19 in US20160215059 |
| ICOS | VH | 2319 | SEQ ID NO. 23 in US20160215059 |
| ICOS | VH | 2320 | SEQ ID NO. 7 in US20160215059 |
| IGFI | VH | 2321 | SEQ ID NO. 1 in WO2007118214 |
| IGFI | VH | 2322 | SEQ ID NO. 3 in WO2007118214 |
| IGFI | VH | 2323 | SEQ ID NO. 7 in WO2007118214 |
| IGFR1 | VH | 2324 | SEQ ID NO: 7 in WO2015073575A2 |
| IL13 | VH | 2325 | SEQ ID NO 302. in US20160168242 |

TABLE 10-continued

Variable Heavy and Light Chain Sequences

| Target | Antibody chain | SEQ ID NO | Source |
|---|---|---|---|
| IL13Ra2 | VH | 2326 | SEQ ID NO. 7 in WO2016123143 |
| IL13Ra2 | VH | 2327 | SEQ ID NO. 8 in WO2016123143 |
| IL1RAP | VH | 2328 | SEQ ID NO. 1 in WO2016020502 |
| IL1RAP | VH | 2329 | SEQ ID NO. 10 in WO2016020502 |
| IL1RAP | VH | 2330 | SEQ ID NO. 19 in WO2016020502 |
| IL1RAP | VH | 2331 | SEQ ID NO. 8 in WO2016020502 |
| IL1RAP | VH | 2332 | SEQ ID NO. 9 in WO2016020502 |
| IL1RAP | VH | 2333 | SEQ ID NO: 120 in WO2016179319A1 |
| IL1RAP | VH | 2334 | SEQ ID NO: 122 in WO2016179319A1 |
| IL1RAP | VH | 2335 | SEQ ID NO: 124 in WO2016179319A1 |
| IL21 | VH | 2336 | SEQ ID NO. 2 in US20160145332 |
| IL21 | VH | 2337 | SEQ ID NO. 3 in US20160145332 |
| IL33 | VH | 2338 | SEQ ID NO 134. in US20160168242 |
| IL33 | VH | 2339 | SEQ ID NO 136. in US20160168242 |
| IL33 | VH | 2340 | SEQ ID NO 138. in US20160168242 |
| IL33 | VH | 2341 | SEQ ID NO 183. in US20160168242 |
| IL33 | VH | 2342 | SEQ ID NO 185. in US20160168242 |
| IL33 | VH | 2343 | SEQ ID NO 187. in US20160168242 |
| IL33 | VH | 2344 | SEQ ID NO 189. in US20160168242 |
| IL33 | VH | 2345 | SEQ ID NO 216. in US20160168242 |
| IL33 | VH | 2346 | SEQ ID NO 218. in US20160168242 |
| IL33 | VH | 2347 | SEQ ID NO 220. in US20160168242 |
| IL33 | VH | 2348 | SEQ ID NO 221. in US20160168242 |
| IL33 | VH | 2349 | SEQ ID NO 236. in US20160168242 |
| IL33 | VH | 2350 | SEQ ID NO 246. in US20160168242 |
| IL33 | VH | 2351 | SEQ ID NO 282. in US20160168242 |
| IL33 | VH | 2352 | SEQ ID NO 284. in US20160168242 |
| IL33 | VH | 2353 | SEQ ID NO 286. in US20160168242 |
| IL33 | VH | 2354 | SEQ ID NO 36. in US20160168242 |
| IL33 | VH | 2355 | SEQ ID NO 38. in US20160168242 |
| IL33 | VH | 2356 | SEQ ID NO 40. in US20160168242 |
| IL33 | VH | 2357 | SEQ ID NO 84. in US20160168242 |
| IL33 | VH | 2358 | SEQ ID NO 86. in US20160168242 |
| IL33 | VH | 2359 | SEQ ID NO 88. in US20160168242 |
| IL3alpha | VH | 2360 | SEQ ID NO. 22 in WO2008127735 |
| Integrin | VH | 2361 | SEQ ID NO. 3 in US 20140161794 |
| Integrin | VH | 2362 | SEQ ID NO. 4 in US 20140161794 |
| Integrin | VH | 2363 | SEQ ID NO. 5 in US 20140161794 |
| KDR | VH | 2364 | SEQ ID NO. 20 IN WO2003075840 |
| KDR | VH | 2365 | SEQ ID NO. 24 IN WO2003075840 |
| KDR | VH | 2366 | SEQ ID NO. 26 IN WO2003075840 |
| KDR | VH | 2367 | SEQ ID NO. 29 IN WO2003075840 |
| KDR | VH | 2368 | SEQ ID NO. 31 IN WO2003075840 |
| KDR | VH | 2369 | SEQ ID NO. 33 IN WO2003075840 |
| KIR(Lirilumab) | VH | 2370 | SEQ ID NO. 3 in US20150290316 |
| KIR(Lirilumab) | VH | 2371 | SEQ ID NO. 1 in WO2014055648 |
| KIR2DL1andKIR2DL2/3 | VH | 2372 | SEQIDNO: 36 in WO2016126213A1 |
| Klon43 | VH | 2373 | SEQ ID NO: 47 in WO2016097231 |
| KMA | VH | 2374 | SEQ ID NO: 22 in WO2016172703A2 |
| LAG3 | VH | 2375 | SEQ ID NO. 100 in US20150259420 |
| LAG3 | VH | 2376 | SEQ ID NO. 104 in US20150259420 |
| LAG3 | VH | 2377 | SEQ ID NO. 108 in US20150259420 |
| LAG3 | VH | 2378 | SEQ ID NO. 28 in US20150259420 |
| LAG3 | VH | 2379 | SEQ ID NO. 64 in US20150259420 |
| LAG3 | VH | 2380 | SEQ ID NO. 68 in US20150259420 |
| LAG3 | VH | 2381 | SEQ ID NO. 72 in US20150259420 |
| LAG3 | VH | 2382 | SEQ ID NO. 76 in US20150259420 |
| LAG3 | VH | 2383 | SEQ ID NO. 8 in US20150259420 |
| LAG3 | VH | 2384 | SEQ ID NO. 80 in US20150259420 |
| LAG3 | VH | 2385 | SEQ ID NO. 1 in WO2015042246 |
| leukocytegenA0 | VH | 2386 | SEQ ID NO. 9 in WO2010065962A2 |
| leukocytegenA2 | VH | 2387 | SEQ ID NO. 25 in WO2010065962A2 |
| LGR4 | VH | 2388 | SEQ ID NO. 12 in US20160046723 |
| LGR4 | VH | 2389 | SEQ ID NO. 13 in US20160046723 |
| LGR4 | VH | 2390 | SEQ ID NO. 5 in US20160046723 |
| LGR4 | VH | 2391 | SEQ ID NO. 9 in US20160046723 |
| LGR5 | VH | 2392 | SEQ ID NO. 10 in US20160102146 |
| LGR5 | VH | 2393 | SEQ ID NO. 12 in US20160102146 |
| LGR5 | VH | 2394 | SEQ ID NO. 16 in US20160102146 |
| LGR5 | VH | 2395 | SEQ ID NO. 18 in US20160102146 |
| LGR5 | VH | 2396 | SEQ ID NO. 20 in US20160102146 |
| LGR5 | VH | 2397 | SEQ ID NO. 22 in US20160102146 |
| LGR5 | VH | 2398 | SEQ ID NO. 24 in US20160102146 |
| LGR5 | VH | 2399 | SEQ ID NO. 26 in US20160102146 |
| LGR5 | VH | 2400 | SEQ ID NO. 4 in US20160102146 |

TABLE 10-continued

Variable Heavy and Light Chain Sequences

| Target | Antibody chain | SEQ ID NO | Source |
|---|---|---|---|
| LHR | VH | 2401 | SEQ ID NO: 1 in WO2016160618A3 |
| LHR | VH | 2402 | SEQ ID NO: 2 in WO2016160618A3 |
| LHR | VH | 2403 | SEQ ID NO: 3 in WO2016160618A3 |
| LHR | VH | 2404 | SEQ ID NO: 4 in WO2016160618A3 |
| LHR | VH | 2405 | SEQ ID NO: 5 in WO2016160618A3 |
| LHR | VH | 2406 | SEQ ID NO: 6 in WO2016160618A3 |
| LHR | VH | 2407 | SEQ ID NO: 7 in WO2016160618A3 |
| LHR | VH | 2408 | SEQ ID NO: 8 in WO2016160618A3 |
| 1L4R | VH | 2409 | SEQ ID NO. 10 in WO2009121847 |
| 1L4R | VH | 2410 | SEQ ID NO. 11 in WO2009121847 |
| 1L4R | VH | 2411 | SEQ ID NO. 14 in WO2009121847 |
| 1L4R | VH | 2412 | SEQ ID NO. 15 in WO2009121847 |
| 1L4R | VH | 2413 | SEQ ID NO. 9 in WO2009121847 |
| Lymphotoxin beta receptor | VH | 2414 | SEQ ID NO. 10 in WO2004002431 |
| Lymphotoxin beta receptor | VH | 2415 | SEQ ID NO. 12 in WO2004002431 |
| Lymphotoxin beta receptor | VH | 2416 | SEQ ID NO. 14 in WO2004002431 |
| Lymphotoxin beta receptor | VH | 2417 | SEQ ID NO. 16 in WO2004002431 |
| Lymphotoxin beta receptor | VH | 2418 | SEQ ID NO. 2 in WO2004002431 |
| Lysyloxidaselike2 | VH | 2419 | SEQ ID NO. 42 in WO2011097513 |
| Lysyloxidaselike2 | VH | 2420 | SEQ ID NO. 44 in WO2011097513 |
| Malignant Variable Receptor | VH | 2421 | SEQ ID NO. 1 in WO2015133817A1 |
| MCAM | VH | 2422 | SEQ ID NO. 115 in US20150259419 |
| MCAM | VH | 2423 | SEQ ID NO. 116 in US20150259419 |
| MCAM | VH | 2424 | SEQ ID NO. 117 in US20150259419 |
| MCAM | VH | 2425 | SEQ ID NO. 118 in US20150259419 |
| MCAM | VH | 2426 | SEQ ID NO. 119 in US20150259419 |
| MCAM | VH | 2427 | SEQ ID NO. 157 in US20150259419 |
| MCAM | VH | 2428 | SEQ ID NO. 158 in US20150259419 |
| MCAM | VH | 2429 | SEQ ID NO. 159 in US20150259419 |
| MCAM | VH | 2430 | SEQ ID NO. 160 in US20150259419 |
| MCAM | VH | 2431 | SEQ ID NO. 161 in US20150259419 |
| MCAM | VH | 2432 | SEQ ID NO. 178 in US20150259419 |
| MCAM | VH | 2433 | SEQ ID NO. 179 in US20150259419 |
| MCAM | VH | 2434 | SEQ ID NO. 35 in US20150239980 |
| MCAM | VH | 2435 | SEQ ID NO. 45 in US20150239980 |
| MCAM | VH | 2436 | SEQ ID NO. 55 in US20150239980 |
| MCAM | VH | 2437 | SEQ ID NO. 65 in US20150239980 |
| MCAM | VH | 2438 | SEQ ID NO. 77 in US20150239980 |
| MCAM | VH | 2439 | SEQ ID NO. 89 in US20150239980 |
| MCSF | VH | 2440 | SEQ ID NO 102 in WO2005030124 |
| MCSF | VH | 2441 | SEQ ID NO 10 in WO2005030124 |
| MCSF | VH | 2442 | SEQ ID NO 14 in WO2005030124 |
| MCSF | VH | 2443 | SEQ ID NO 18 in WO2005030124 |
| MCSF | VH | 2444 | SEQ ID NO 2 in WO2005030124 |
| MCSF | VH | 2445 | SEQ ID NO 22 in WO2005030124 |
| MCSF | VH | 2446 | SEQ ID NO 26 in WO2005030124 |
| MCSF | VH | 2447 | SEQ ID NO 30 in WO2005030124 |
| MCSF | VH | 2448 | SEQ ID NO 34 in WO2005030124 |
| MCSF | VH | 2449 | SEQ ID NO 38 in WO2005030124 |
| MCSF | VH | 2450 | SEQ ID NO 46 in WO2005030124 |
| MCSF | VH | 2451 | SEQ ID NO 50 in WO2005030124 |
| MCSF | VH | 2452 | SEQ ID NO 54 in WO2005030124 |
| MCSF | VH | 2453 | SEQ ID NO 58 in WO2005030124 |
| MCSF | VH | 2454 | SEQ ID NO 6 in WO2005030124 |
| MCSF | VH | 2455 | SEQ ID NO 66 in WO2005030124 |
| MCSF | VH | 2456 | SEQ ID NO 70 in WO2005030124 |
| MCSF | VH | 2457 | SEQ ID NO 74 in WO2005030124 |
| MCSF | VH | 2458 | SEQ ID NO 78 in WO2005030124 |
| MCSF | VH | 2459 | SEQ ID NO 82 in WO2005030124 |
| MCSF | VH | 2460 | SEQ ID NO 86 in WO2005030124 |
| MCSF | VH | 2461 | SEQ ID NO 90 in WO2005030124 |
| MCSF | VH | 2462 | SEQ ID NO 94 in WO2005030124 |
| MCSF | VH | 2463 | SEQ ID NO 98 in WO2005030124 |
| Mesothelin | VH | 2464 | SEQ ID NO. 1 WO2015188141 |
| Mesothelin | VH | 2465 | SEQ ID NO. 6 WO2015188141 |
| Mesothelin | VH | 2466 | SEQ ID NO: 119 in US20160333114A1 |
| Mesothelin | VH | 2467 | SEQ ID NO: 5 in WO2013142034 |
| Mesothelin | VH | 2468 | SEQ ID NO: 50 in US20160333114A1 |
| Mesothelin | VH | 2469 | SEQ ID NO: 6 in WO2013142034 |
| Mesothelin | VH | 2470 | SEQ ID NO: 15 in U.S. Pat. No. 9,416,190B2 |
| Mesothelin | VH | 2471 | SEQ ID NO: 2 in U.S. Pat. No. 9,416,190B2 |
| MN | VH | 2472 | SEQ ID NO. 133 in WO2007070538 |
| MN | VH | 2473 | SEQ ID NO. 135 in WO2007070538 |
| MN | VH | 2474 | SEQ ID NO. 137 in WO2007070538 |
| MN | VH | 2475 | SEQ ID NO. 139 in WO2007070538 |

TABLE 10-continued

Variable Heavy and Light Chain Sequences

| Target | Antibody chain | SEQ ID NO | Source |
|---|---|---|---|
| MN | VH | 2476 | SEQ ID NO. 141 in WO2007070538 |
| MN | VH | 2477 | SEQ ID NO. 143 in WO2007070538 |
| MN | VH | 2478 | SEQ ID NO. 145 in WO2007070538 |
| MN | VH | 2479 | SEQ ID NO. 147 in WO2007070538 |
| MN | VH | 2480 | SEQ ID NO. 149 in WO2007070538 |
| MN | VH | 2481 | SEQ ID NO. 151 in WO2007070538 |
| MPER | VH | 2482 | SEQ ID NO: 13 in US20160194375A1 |
| MUC1 | VH | 2483 | SEQ ID NO: 5 in US20160130357 |
| MUC1 | VH | 2484 | SEQ ID NO: 2 in WO2013023162 |
| MUC1 | VH | 2485 | SEQ ID NO: 14 in WO2013023162 |
| MUC1 | VH | 2486 | SEQ ID NO. 15 in WO2015116753 |
| MUC1 | VH | 2487 | SEQ ID NO. 19 in WO2015116753 |
| MUC1 | VH | 2488 | SEQ ID NO. 23 in WO2015116753 |
| MUC1 | VH | 2489 | SEQ ID NO. 60 in WO2015116753 |
| MUC1 | VH | 2490 | SEQ ID NO. 64 in WO2015116753 |
| MUC1 | VH | 2491 | SEQ ID NO. 68 in WO2015116753 |
| MUC16 | VH | 2492 | SEQ ID NO. 1 in WO2016149368 |
| MUC16 | VH | 2493 | SEQ ID NO. 11 in US20130171152 |
| MUC16 | VH | 2494 | SEQ ID NO. 21 in WO2016149368 |
| MUC16 | VH | 2495 | SEQ ID NO. 41 in WO2016149368 |
| MUC16 | VH | 2496 | SEQ ID NO. 81 in WO2016149368 |
| MUC16 | VH | 2497 | SEQ ID NO. 4 in US20130171152 |
| MUC16 | VH | 2498 | SEQ ID NO. 6 in US20130171152 |
| MUC16 | VH | 2499 | SEQ ID NO. 61 in WO2016149368 |
| MUC16 | VH | 2500 | SEQ ID NO. 8 in US20130171152 |
| MUCIN1 | VH | 2501 | SEQ ID NO: 101 in EP3049812A2 |
| MUCIN1 | VH | 2502 | SEQ ID NO: 106 in EP3049812A2 |
| MUCIN1 | VH | 2503 | SEQ ID NO: 109 in EP3049812A2 |
| MUCIN1 | VH | 2504 | SEQ ID NO: 115 in EP3049812A2 |
| MUCIN1 | VH | 2505 | SEQ ID NO: 119 in EP3049812A2 |
| MUCIN1 | VH | 2506 | SEQ ID NO: 123 in EP3049812A2 |
| MUCIN1 | VH | 2507 | SEQ ID NO: 127 in EP3049812A2 |
| MUCIN1 | VH | 2508 | SEQ ID NO: 141 in EP3049812A2 |
| MUCIN1 | VH | 2509 | SEQ ID NO: 15 in EP3049812A2 |
| MUCIN1 | VH | 2510 | SEQ ID NO: 23 in EP3049812A2 |
| MUCIN1 | VH | 2511 | SEQ ID NO: 28 in EP3049812A2 |
| MUCIN1 | VH | 2512 | SEQ ID NO: 33 in EP3049812A2 |
| MUCIN1 | VH | 2513 | SEQ ID NO: 39 in EP3049812A2 |
| MUCIN1 | VH | 2514 | SEQ ID NO: 42 in EP3049812A2 |
| MUCIN1 | VH | 2515 | SEQ ID NO: 47 in EP3049812A2 |
| MUCIN1 | VH | 2516 | SEQ ID NO: 5 in EP3049812A2 |
| MUCIN1 | VH | 2517 | SEQ ID NO: 57 in EP3049812A2 |
| MUCIN1 | VH | 2518 | SEQ ID NO: 66 in EP3049812A2 |
| MUCIN1 | VH | 2519 | SEQ ID NO: 70 in EP3049812A2 |
| MUCIN1 | VH | 2520 | SEQ ID NO: 75 in EP3049812A2 |
| MUCIN1 | VH | 2521 | SEQ ID NO: 80 in EP3049812A2 |
| MUCIN1 | VH | 2522 | SEQ ID NO: 83 in EP3049812A2 |
| MUCIN1 | VH | 2523 | SEQ ID NO: 87 in EP3049812A2 |
| MUCIN1 | VH | 2524 | SEQ ID NO: 92 in EP3049812A2 |
| MVR | VH | 2525 | SEQ ID NO: 1 in US20160257762A1 |
| N Glycan | VH | 2526 | SEQ ID NO: 7 in US20160194375A1 |
| N Glycan | VH | 2527 | SEQ ID NO: 9 in US20160194375A1 |
| NKG2A | VH | 2528 | SEQIDNO: 32 in WO2016126213A1 |
| NKG2A | VH | 2529 | SEQ ID NO. 2 in WO2016041947 |
| NKG2A | VH | 2530 | SEQ ID NO. 3 in WO2016041947 |
| NKG2A | VH | 2531 | SEQ ID NO. 4 in WO2016041947 |
| NKG2A | VH | 2532 | SEQ ID NO. 5 in WO2016041947 |
| NKG2A | VH | 2533 | SEQ ID NO. 6 in WO2016041947 |
| NKG2D | VH | 2534 | SEQ ID NO. 135 in WO2016122701 |
| NKG2D | VH | 2535 | SEQ ID NO. 137 in WO2016122701 |
| NOTCH1 | VH | 2536 | SEQ ID NO: 12 in WO2013074596 |
| NOTCH2/3 | VH | 2537 | SEQ ID NO: 29 in WO2013074596 |
| Notch 1 | VH | 2538 | SEQ ID NO: 58 in US20160333114A1 |
| Notum | VH | 2539 | SEQ ID NO: 56 in WO2012027723 |
| Notum | VH | 2540 | SEQ ID NO: 331 in WO2012027723 |
| Olfml3 | VH | 2541 | SEQ ID NO. 1 in WO2015054441A1 |
| Olfml3 | VH | 2542 | SEQ ID NO. 19 in WO2015054441A1 |
| Olfml3 | VH | 2543 | SEQ ID NO. 3 in WO2015054441A1 |
| Osteonectin | VH | 2544 | SEQ ID NO. 58 in WO2016112870 |
| OX40 | VH | 2545 | SEQ ID NO. 101 in WO2016196228 |
| OX40 | VH | 2546 | SEQ ID NO. 103 in WO2016196228 |
| OX40 | VH | 2547 | SEQ ID NO. 105 in WO2016196228 |
| OX40 | VH | 2548 | SEQ ID NO. 107 in WO2016196228 |
| OX40 | VH | 2549 | SEQ ID NO. 109 in WO2016196228 |
| OX40 | VH | 2550 | SEQ ID NO. 111 in WO2016196228 |

TABLE 10-continued

Variable Heavy and Light Chain Sequences

| Target | Antibody chain | SEQ ID NO | Source |
|---|---|---|---|
| OX40 | VH | 2551 | SEQ ID NO. 113 in WO2016196228 |
| OX40 | VH | 2552 | SEQ ID NO. 115 in WO2016196228 |
| OX40 | VH | 2553 | SEQ ID NO. 117 in WO2016196228 |
| OX40 | VH | 2554 | SEQ ID NO. 119 in WO2016196228 |
| OX40 | VH | 2555 | SEQ ID NO. 121 in WO2016196228 |
| OX40 | VH | 2556 | SEQ ID NO. 123 in WO2016196228 |
| OX40 | VH | 2557 | SEQ ID NO. 124 in WO2016196228 |
| OX40 | VH | 2558 | SEQ ID NO. 125 in WO2016196228 |
| OX40 | VH | 2559 | SEQ ID NO. 15 in U.S. Pat. No. 9,428,570 |
| OX40 | VH | 2560 | SEQ ID NO. 17 in WO2016196228 |
| OX40 | VH | 2561 | SEQ ID NO. 28 in WO2016196228 |
| OX40 | VH | 2562 | SEQ ID NO. 29 in WO2016196228 |
| OX40 | VH | 2563 | SEQ ID NO. 31 in US20150190506 |
| OX40 | VH | 2564 | SEQ ID NO. 318 in WO2016196228 |
| OX40 | VH | 2565 | SEQ ID NO. 33 in US20160137740 |
| OX40 | VH | 2566 | SEQ ID NO. 34 in US20150190506 |
| OX40 | VH | 2567 | SEQ ID NO. 35 in US20160137740 |
| OX40 | VH | 2568 | SEQ ID NO. 36 in US20150190506 |
| OX40 | VH | 2569 | SEQ ID NO. 37 in US20160137740 |
| OX40 | VH | 2570 | SEQ ID NO. 37 in WO2016196228 |
| OX40 | VH | 2571 | SEQ ID NO. 38 in US20150190506 |
| OX40 | VH | 2572 | SEQ ID NO. 39 in US20160137740 |
| OX40 | VH | 2573 | SEQ ID NO. 40 in US20150190506 |
| OX40 | VH | 2574 | SEQ ID NO. 41 in US20160137740 |
| OX40 | VH | 2575 | SEQ ID NO. 42 in US20150190506 |
| OX40 | VH | 2576 | SEQ ID NO. 43 in US20160137740 |
| OX40 | VH | 2577 | SEQ ID NO. 44 in US20150190506 |
| OX40 | VH | 2578 | SEQ ID NO. 44 in U.S. Pat. No. 8,283,450 |
| OX40 | VH | 2579 | SEQ ID NO. 45 in US20160137740 |
| OX40 | VH | 2580 | SEQ ID NO. 46 in US20150190506 |
| OX40 | VH | 2581 | SEQ ID NO. 46 in U.S. Pat. No. 8,283,450 |
| OX40 | VH | 2582 | SEQ ID NO. 47 in US20160137740 |
| OX40 | VH | 2583 | SEQ ID NO. 48 in US20150190506 |
| OX40 | VH | 2584 | SEQ ID NO. 48 in U.S. Pat. No. 8,283,450 |
| OX40 | VH | 2585 | SEQ ID NO. 48 in WO2016196228 |
| OX40 | VH | 2586 | SEQ ID NO. 49 in US20160137740 |
| OX40 | VH | 2587 | SEQ ID NO. 50 in US20150190506 |
| OX40 | VH | 2588 | SEQ ID NO. 50 in WO2016196228 |
| OX40 | VH | 2589 | SEQ ID NO. 51 in US20160137740 |
| OX40 | VH | 2590 | SEQ ID NO. 53 in US20150190506 |
| OX40 | VH | 2591 | SEQ ID NO. 53 in US20160137740 |
| OX40 | VH | 2592 | SEQ ID NO. 54 in US20150190506 |
| OX40 | VH | 2593 | SEQ ID NO. 55 in US20150190506 |
| OX40 | VH | 2594 | SEQ ID NO. 55 in US20160137740 |
| OX40 | VH | 2595 | SEQ ID NO. 57 in US20160137740 |
| OX40 | VH | 2596 | SEQ ID NO. 58 in US20150190506 |
| OX40 | VH | 2597 | SEQ ID NO. 58 in WO2016196228 |
| OX40 | VH | 2598 | SEQ ID NO. 59 in US20150190506 |
| OX40 | VH | 2599 | SEQ ID NO. 59 in US20160137740 |
| OX40 | VH | 2600 | SEQ ID NO. 61 in US20150190506 |
| OX40 | VH | 2601 | SEQ ID NO. 61 in US20160137740 |
| OX40 | VH | 2602 | SEQ ID NO. 63 in US20160137740 |
| OX40 | VH | 2603 | SEQ ID NO. 65 in US20160137740 |
| OX40 | VH | 2604 | SEQ ID NO. 66 in WO2016196228 |
| OX40 | VH | 2605 | SEQ ID NO. 67 in US20160137740 |
| OX40 | VH | 2606 | SEQ ID NO. 7 in U.S. Pat. No. 8,283,450 |
| OX40 | VH | 2607 | SEQ ID NO. 71 in US20160137740 |
| OX40 | VH | 2608 | SEQ ID NO. 74 in WO2016196228 |
| OX40 | VH | 2609 | SEQ ID NO. 85 in WO2016196228 |
| OX40 | VH | 2610 | SEQ ID NO. 9 in U.S. Pat. No. 9,428,570 |
| OX40 | VH | 2611 | SEQ ID NO. 9 in U.S. Pat. No. 8,283,450 |
| OX40 | VH | 2612 | SEQ ID NO. 93 in WO2016196228 |
| OX40 | VH | 2613 | SEQ ID NO. 95 in WO2016196228 |
| OX40 | VH | 2614 | SEQ ID NO. 97 in WO2016196228 |
| OX40 | VH | 2615 | SEQ ID NO. 99 in WO2016196228 |
| PD1 | VH | 2616 | SEQ ID NO. 19 in US20150290316 |
| PD1 | VH | 2617 | SEQ ID NO. 25 in US20130291136 |
| PD1 | VH | 2618 | SEQ ID NO. 26 in US20130291136 |
| PD1 | VH | 2619 | SEQ ID NO. 27 in US20130291136 |
| PD1 | VH | 2620 | SEQ ID NO. 28 in US20130291136 |
| PD1 | VH | 2621 | SEQ ID NO. 29 in US 20160159905 |
| PD1 | VH | 2622 | SEQ ID NO. 29 in US20130291136 |
| PD1 | VH | 2623 | SEQ ID NO. 3 in US 20160159905 |
| PD1 | VH | 2624 | SEQ ID NO. 38 in US 20160159905 |
| PD1 | VH | 2625 | SEQ ID NO. 38 in WO2015112900 |

TABLE 10-continued

Variable Heavy and Light Chain Sequences

| Target | Antibody chain | SEQ ID NO | Source |
|---|---|---|---|
| PD1 | VH | 2626 | SEQ ID NO. 4 in US 20160159905 |
| PD1 | VH | 2627 | SEQ ID NO. 5 in US 20160159905 |
| PD1 | VH | 2628 | SEQ ID NO. 50 in WO2015112900 |
| PD1 | VH | 2629 | SEQ ID NO. 6 in US 20160159905 |
| PD1 | VH | 2630 | SEQ ID NO. 82 in WO2015112900 |
| PD1 | VH | 2631 | SEQ ID NO. 86 in WO2015112900 |
| PD1 | VH | 2632 | SEQ ID NO. 17 in WO2014055648 |
| PD1(Nivolumab) | VH | 2633 | SEQ ID NO. 2 in WO2016040892 |
| PD1(Nivolumab) | VH | 2634 | SEQ ID NO. 10 in US20150190506 |
| PD1(Pembrolizumab) | VH | 2635 | SEQ ID NO. 4 in WO2016040892 |
| PD1(Pembrolizumab) | VH | 2636 | SEQ ID NO. 12 in US20150190506 |
| PDK1 | VH | 2637 | SEQ ID NO. 2 in WO2016090365 |
| PDL1 | VH | 2638 | SEQ ID NO. 10 in US20160319022 |
| PDL1 | VH | 2639 | SEQ ID NO. 18 in WO2016061142 |
| PDL1 | VH | 2640 | SEQ ID NO. 29 in US20150190506 |
| PDL1 | VH | 2641 | SEQ ID NO. 30 in WO2016061142 |
| PDL1 | VH | 2642 | SEQ ID NO. 32 in US20160319022 |
| PDL1 | VH | 2643 | SEQ ID NO. 38 in WO2016061142 |
| PDL1 | VH | 2644 | SEQ ID NO. 46 in WO2016061142 |
| PDL1 | VH | 2645 | SEQ ID NO. 50 in WO2016061142 |
| PDL1 | VH | 2646 | SEQ ID NO. 54 in WO2016061142 |
| PDL1 | VH | 2647 | SEQ ID NO. 62 in WO2016061142 |
| PDL1 | VH | 2648 | SEQ ID NO. 7 in US20150190506 |
| PDL1 | VH | 2649 | SEQ ID NO. 70 in WO2016061142 |
| PDL1 | VH | 2650 | SEQ ID NO. 78 in WO2016061142 |
| PDL1 | VH | 2651 | SEQ ID NO. 8 in US20160319022 |
| PDL1 | VH | 2652 | US20160108123 SEQ ID NO: 16 |
| PDL1 | VH | 2653 | US20160108123 SEQ ID NO: 18 |
| PDL1 | VH | 2654 | US20160108123 SEQ ID NO: 197 |
| PDL1 | VH | 2655 | US20160108123 SEQ ID NO: 247 |
| PDL1 | VH | 2656 | US20160108123 SEQ ID NO: 248 |
| PDL1 | VH | 2657 | US20160108123 SEQ ID NO: 250 |
| PDL1 | VH | 2658 | US20160108123 SEQ ID NO: 251 |
| PDL1 | VH | 2659 | US20160108123 SEQ ID NO: 252 |
| PDL1 | VH | 2660 | US20160108123 SEQ ID NO: 253 |
| PDL1 | VH | 2661 | US20160108123 SEQ ID NO: 254 |
| PDL1 | VH | 2662 | US20160108123 SEQ ID NO: 255 |
| PDL1 | VH | 2663 | US20160108123 SEQ ID NO: 256 |
| PDL1 | VH | 2664 | US20160108123 SEQ ID NO: 257 |
| PDL1 | VH | 2665 | US20160108123 SEQ ID NO: 258 |
| PDL1 | VH | 2666 | US20160108123 SEQ ID NO: 259 |
| PDL1 | VH | 2667 | US20160108123 SEQ ID NO: 260 |
| PDL1 | VH | 2668 | US20160108123 SEQ ID NO: 30 |
| PDL1 | VH | 2669 | US20160108123 SEQ ID NO: 308 |
| PDL1 | VH | 2670 | US20160108123 SEQ ID NO: 310 |
| PDL1 | VH | 2671 | US20160108123 SEQ ID NO: 312 |
| PDL1 | VH | 2672 | US20160108123 SEQ ID NO: 319 |
| PDL1 | VH | 2673 | US20160108123 SEQ ID NO: 32 |
| PDL1 | VH | 2674 | US20160108123 SEQ ID NO: 324 |
| PDL1 | VH | 2675 | US20160108123 SEQ ID NO: 339 |
| PDL1 | VH | 2676 | US20160108123 SEQ ID NO: 356 |
| PDL1 | VH | 2677 | US20160108123 SEQ ID NO: 38 |
| PDL1 | VH | 2678 | US20160108123 SEQ ID NO: 40 |
| PDL1 | VH | 2679 | US20160108123 SEQ ID NO: 46 |
| PDL1 | VH | 2680 | US20160108123 SEQ ID NO: 48 |
| PDL1 | VH | 2681 | US20160108123 SEQ ID NO: 50 |
| PDL1 | VH | 2682 | US20160108123 SEQ ID NO: 52 |
| PDL1 | VH | 2683 | US20160108123 SEQ ID NO: 54 |
| PDL1 | VH | 2684 | US20160108123 SEQ ID NO: 6 |
| PDL1 | VH | 2685 | US20160108123 SEQ ID NO: 62 |
| PDL1 | VH | 2686 | US20160108123 SEQ ID NO: 70 |
| PDL1 | VH | 2687 | US20160108123 SEQ ID NO: 72 |
| PDL1 | VH | 2688 | US20160108123 SEQ ID NO: 78 |
| PDL1 | VH | 2689 | US20160108123 SEQ ID NO: 80 |
| PDL1 | VH | 2690 | US20160108123 SEQ ID NO: 91 |
| PDL1 | VH | 2691 | US20160108123 SEQ ID NO: 96 |
| PDL2 | VH | 2692 | SEQ ID NO. 43 in US20130291136 |
| PDL2 | VH | 2693 | SEQ ID NO. 44 in US20130291136 |
| PDL2 | VH | 2694 | SEQ ID NO. 45 in US20130291136 |
| PDL2 | VH | 2695 | SEQ ID NO. 46 in US20130291136 |
| PG16 | VH | 2696 | SEQ ID NO: 13 in EP3074419A2 |
| PG9 | VH | 2697 | SEQ ID NO: 11 in EP3074419A2 |
| PGT1 | VH | 2698 | SEQ ID NO: 15 in EP3074419A2 |
| PGT2 | VH | 2699 | SEQ ID NO: 17 in EP3074419A2 |
| PGT3 | VH | 2700 | SEQ ID NO: 19 in EP3074419A2 |

TABLE 10-continued

Variable Heavy and Light Chain Sequences

| Target | Antibody chain | SEQ ID NO | Source |
|---|---|---|---|
| PGT4 | VH | 2701 | SEQ ID NO: 21 in EP3074419A2 |
| PGT5 | VH | 2702 | SEQ ID NO: 23 in EP3074419A2 |
| PRAME | VH | 2703 | SEQ ID NO: 50 in WO2016191246A2 |
| PRAME | VH | 2704 | SEQ ID NO: 52 in WO2016191246A2 |
| PRAME | VH | 2705 | SEQ ID NO: 54 in WO2016191246A2 |
| PRAME | VH | 2706 | SEQ ID NO: 56 in WO2016191246A2 |
| PRAME | VH | 2707 | SEQ ID NO: 58 in WO2016191246A2 |
| PRAME | VH | 2708 | SEQ ID NO: 60 in WO2016191246A2 |
| PRAME | VH | 2709 | SEQ ID NO: 62 in WO2016191246A2 |
| PRP | VH | 2710 | SEQ ID NO: 42 in US20160333114A1 |
| PSMA | VH | 2711 | SEQ ID NO: 43 in WO2016097231 |
| PTK7 | VH | 2712 | SEQ ID NO. 21 in WO2012112943A1 |
| PTK7 | VH | 2713 | SEQ ID NO. 23 in WO2012112943A1 |
| PTK7 | VH | 2714 | SEQ ID NO. 25 in WO2012112943A1 |
| PTK7 | VH | 2715 | SEQ ID NO. 27 in WO2012112943A1 |
| PTK7 | VH | 2716 | SEQ ID NO. 29 in WO2012112943A1 |
| PTK7 | VH | 2717 | SEQ ID NO. 31 in WO2012112943A1 |
| PTK7 | VH | 2718 | SEQ ID NO. 33 in WO2012112943A1 |
| PTK7 | VH | 2719 | SEQ ID NO. 35 in WO2012112943A1 |
| PTK7 | VH | 2720 | SEQ ID NO. 37 in WO2012112943A1 |
| PTK7 | VH | 2721 | SEQ ID NO. 39 in WO2012112943A1 |
| PTK7 | VH | 2722 | SEQ ID NO. 41 in WO2012112943A1 |
| PTK7 | VH | 2723 | SEQ ID NO. 43 in WO2012112943A1 |
| PTK7 | VH | 2724 | SEQ ID NO. 45 in WO2012112943A1 |
| PTK7 | VH | 2725 | SEQ ID NO. 47 in WO2012112943A1 |
| PTK7 | VH | 2726 | SEQ ID NO. 49 in WO2012112943A1 |
| PTK7 | VH | 2727 | SEQ ID NO. 51 in WO2012112943A1 |
| PTK7 | VH | 2728 | SEQ ID NO. 53 in WO2012112943A1 |
| PTK7 | VH | 2729 | SEQ ID NO. 55 in WO2012112943A1 |
| PTK7 | VH | 2730 | SEQ ID NO. 57 in WO2012112943A1 |
| PTK7 | VH | 2731 | SEQ ID NO. 59 in WO2012112943A1 |
| PTK7 | VH | 2732 | SEQ ID NO. 61 in WO2012112943A1 |
| PTK7 | VH | 2733 | SEQ ID NO. 63 in WO2012112943A1 |
| PTK7 | VH | 2734 | SEQ ID NO. 65 in WO2012112943A1 |
| PTK7 | VH | 2735 | SEQ ID NO. 67 in WO2012112943A1 |
| PTK7 | VH | 2736 | SEQ ID NO. 69 in WO2012112943A1 |
| RAS | VH | 2737 | SEQ ID NO. 17 in WO2016154047 |
| RAS | VH | 2738 | SEQ ID NO. 47 in WO2016154047 |
| RAS | VH | 2739 | SEQ ID NO. 57 in WO2016154047 |
| RAS | VH | 2740 | SEQ ID NO. 67 in WO2016154047 |
| RAS | VH | 2741 | SEQ ID NO. 7 in WO2016154047 |
| RAS | VH | 2742 | SEQ ID NO. 77 in WO2016154047 |
| RHAMM | VH | 2743 | SEQ ID NO. 4 in US20020127227A1 |
| RHAMM antagonist body heavy chain | VH | 2744 | SEQ ID NO 2 in WO2000029447 |
| Rituximab | VH | 2745 | SEQ ID NO: 66 in US20160333114A1 |
| ROR1 | VH | 2746 | SEQ ID NO. 12 WO2016016343A1 |
| ROR1 | VH | 2747 | SEQ ID NO. 20 WO2016016343A1 |
| ROR1 | VH | 2748 | SEQ ID NO. 28 WO2016016343A1 |
| ROR1 | VH | 2749 | SEQ ID NO. 36 WO2016016343A1 |
| ROR1 | VH | 2750 | SEQ ID NO. 44 WO2016016343A1 |
| ROR1 | VH | 2751 | SEQ ID NO. 60 WO2016016343A1 |
| ROR1 | VH | 2752 | SEQ ID NO. 68 WO2016016343A1 |
| ROR1 | VH | 2753 | SEQ ID NO. 57 in WO2016016344A1 |
| ROR1 | VH | 2754 | SEQ ID NO. 19 in WO2016016344A1 |
| ROR1 | VH | 2755 | SEQ ID NO. 31 in WO2016016344A1 |
| ROR1 | VH | 2756 | SEQ ID NO. 45 in WO2016016344A1 |
| ROR1 | VH | 2757 | SEQ ID NO. 53 in WO2016016344A1 |
| ROR1 | VH | 2758 | SEQ ID NO. 71 in WO2016016344A1 |
| ROR1 | VH | 2759 | SEQ ID NO. 85 in WO2016120216 |
| ROR1 | VH | 2760 | SEQ ID NO. 87 in WO2016120216 |
| ROR1 | VH | 2761 | SEQ ID NO. 89 in WO2016120216 |
| ROR1 | VH | 2762 | SEQ ID NO: 122 in US20160208018A1 |
| ROR1 | VH | 2763 | SEQ ID NO: 125 in US20160208018A1 |
| ROR1 | VH | 2764 | SEQ ID NO: 175 in US20160208018A1 |
| ROR1 | VH | 2765 | SEQ ID NO: 176 in US20160208018A1 |
| ROR1 | VH | 2766 | SEQ ID NO: 179 in US20160208018A1 |
| ROR1 | VH | 2767 | SEQ ID NO: 180 in US20160208018A1 |
| ROR1 | VH | 2768 | SEQ ID NO: 181 in US20160208018A1 |
| ROR1 | VH | 2769 | SEQ ID NO: 182 in US20160208018A1 |
| ROR1 | VH | 2770 | SEQ ID NO: 183 in US20160208018A1 |
| ROR1 | VH | 2771 | SEQ ID NO: 184 in US20160208018A1 |
| ROR1 | VH | 2772 | SEQ ID NO: 185 in US20160208018A1 |
| ROR1 | VH | 2773 | SEQ ID NO: 186 in US20160208018A1 |
| ROR1 | VH | 2774 | SEQ ID NO: 187 in US20160208018A1 |

TABLE 10-continued

Variable Heavy and Light Chain Sequences

| Target | Antibody chain | SEQ ID NO | Source |
|---|---|---|---|
| ROR1 | VH | 2775 | SEQ ID NO: 188 in US20160208018A1 |
| ROR1 | VH | 2776 | SEQ ID NO: 189 in US20160208018A1 |
| ROR1 | VH | 2777 | SEQ ID NO: 190 in US20160208018A1 |
| ROR1 | VH | 2778 | SEQ ID NO: 191 in US20160208018A1 |
| ROR1 | VH | 2779 | SEQ ID NO: 192 in US20160208018A1 |
| ROR1 | VH | 2780 | SEQ ID NO: 193 in US20160208018A1 |
| ROR1 | VH | 2781 | SEQ ID NO: 194 in US20160208018A1 |
| ROR1 | VH | 2782 | SEQ ID NO: 195 in US20160208018A1 |
| ROR1 | VH | 2783 | SEQ ID NO: 196 in US20160208018A1 |
| ROR1 | VH | 2784 | SEQ ID NO: 197 in US20160208018A1 |
| ROR1 | VH | 2785 | SEQ ID NO: 198 in US20160208018A1 |
| ROR1 | VH | 2786 | SEQ ID NO: 199 in US20160208018A1 |
| ROR1 | VH | 2787 | SEQ ID NO: 200 in US20160208018A1 |
| ROR1 | VH | 2788 | SEQ ID NO: 201 in US20160208018A1 |
| ROR1 | VH | 2789 | SEQ ID NO: 202 in US20160208018A1 |
| ROR1 | VH | 2790 | SEQ ID NO: 203 in US20160208018A1 |
| ROR1 | VH | 2791 | SEQ ID NO: 204 in US20160208018A1 |
| ROR1 | VH | 2792 | SEQ ID NO: 205 in US20160208018A1 |
| ROR1 | VH | 2793 | SEQ ID NO: 206 in US20160208018A1 |
| ROR1 | VH | 2794 | SEQ ID NO: 207 in US20160208018A1 |
| ROR1 | VH | 2795 | SEQ ID NO: 208 in US20160208018A1 |
| ROR1 | VH | 2796 | SEQ ID NO: 209 in US20160208018A1 |
| ROR1 | VH | 2797 | SEQ ID NO: 55 in EP3083671A1 |
| ROR1 | VH | 2798 | SEQ ID NO: 104 in WO2016187216A1 |
| ROR1 | VH | 2799 | SEQ ID NO: 112 in WO2016187216A1 |
| ROR1 | VH | 2800 | SEQ ID NO: 120 in WO2016187216A1 |
| ROR1 | VH | 2801 | SEQ ID NO: 128 in WO2016187216A1 |
| ROR1 | VH | 2802 | SEQ ID NO: 152 in WO2016187216A1 |
| ROR1 | VH | 2803 | SEQ ID NO: 16 in WO2016187216A1 |
| ROR1 | VH | 2804 | SEQ ID NO: 160 in WO2016187216A1 |
| ROR1 | VH | 2805 | SEQ ID NO: 168 in WO2016187216A1 |
| ROR1 | VH | 2806 | SEQ ID NO: 176 in WO2016187216A1 |
| ROR1 | VH | 2807 | SEQ ID NO: 184 in WO2016187216A1 |
| ROR1 | VH | 2808 | SEQ ID NO: 192 in WO2016187216A1 |
| ROR1 | VH | 2809 | SEQ ID NO: 200 in WO2016187216A1 |
| ROR1 | VH | 2810 | SEQ ID NO: 208 in WO2016187216A1 |
| ROR1 | VH | 2811 | SEQ ID NO: 216 in WO2016187216A1 |
| ROR1 | VH | 2812 | SEQ ID NO: 224 in WO2016187216A1 |
| ROR1 | VH | 2813 | SEQ ID NO: 232 in WO2016187216A1 |
| ROR1 | VH | 2814 | SEQ ID NO: 24 in WO2016187216A1 |
| ROR1 | VH | 2815 | SEQ ID NO: 240 in WO2016187216A1 |
| ROR1 | VH | 2816 | SEQ ID NO: 248 in WO2016187216A1 |
| ROR1 | VH | 2817 | SEQ ID NO: 256 in WO2016187216A1 |
| ROR1 | VH | 2818 | SEQ ID NO: 264 in WO2016187216A1 |
| ROR1 | VH | 2819 | SEQ ID NO: 272 in WO2016187216A1 |
| ROR1 | VH | 2820 | SEQ ID NO: 280 in WO2016187216A1 |
| ROR1 | VH | 2821 | SEQ ID NO: 288 in WO2016187216A1 |
| ROR1 | VH | 2822 | SEQ ID NO: 296 in WO2016187216A1 |
| ROR1 | VH | 2823 | SEQ ID NO: 304 in WO2016187216A1 |
| ROR1 | VH | 2824 | SEQ ID NO: 312 in WO2016187216A1 |
| ROR1 | VH | 2825 | SEQ ID NO: 32 in WO2016187216A1 |
| ROR1 | VH | 2826 | SEQ ID NO: 320 in WO2016187216A1 |
| ROR1 | VH | 2827 | SEQ ID NO: 336 in WO2016187216A1 |
| ROR1 | VH | 2828 | SEQ ID NO: 344 in WO2016187216A1 |
| ROR1 | VH | 2829 | SEQ ID NO: 352 in WO2016187216A1 |
| ROR1 | VH | 2830 | SEQ ID NO: 360 in WO2016187216A1 |
| ROR1 | VH | 2831 | SEQ ID NO: 40 in WO2016187216A1 |
| ROR1 | VH | 2832 | SEQ ID NO: 48 in WO2016187216A1 |
| ROR1 | VH | 2833 | SEQ ID NO: 56 in WO2016187216A1 |
| ROR1 | VH | 2834 | SEQ ID NO: 64 in WO2016187216A1 |
| ROR1 | VH | 2835 | SEQ ID NO: 72 in WO2016187216A1 |
| ROR1 | VH | 2836 | SEQ ID NO: 8 in WO2016187216A1 |
| ROR1 | VH | 2837 | SEQ ID NO: 80 in WO2016187216A1 |
| ROR1 | VH | 2838 | SEQ ID NO: 88 in WO2016187216A1 |
| SEMAPHORIN4D | VH | 2839 | SEQ ID NO. 10 in US20160115240A1 |
| SEMAPHORIN4D | VH | 2840 | SEQ ID NO. 25 in US20160115240A1 |
| SEMAPHORIN4D | VH | 2841 | SEQ ID NO. 9 in US20160115240A1 |
| TAG72 | VH | 2842 | SEQ ID NO: 115 in US20160333114A1 |
| TCR | VH | 2843 | SEQ ID NO. 133 in WO2016122701 |
| TEM8 | VH | 2844 | SEQ ID NO: 1 in US20160264662A1 |
| TEM8 | VH | 2845 | SEQ ID NO: 3 in US20160264662A1 |
| TEM8 | VH | 2846 | SEQ ID NO: 5 in US20160264662A1 |
| TEM8 | VH | 2847 | SEQ ID NO: 7 in US20160264662A1 |
| Tie | VH | 2848 | SEQ ID NO 723 in US20060057138A1 |
| TIGIT | VH | 2849 | SEQ ID NO. 10 in US20160355589 |

TABLE 10-continued

Variable Heavy and Light Chain Sequences

| Target | Antibody chain | SEQ ID NO | Source |
|---|---|---|---|
| TIGIT | VH | 2850 | SEQ ID NO. 11 in US20160355589 |
| TIGIT | VH | 2851 | SEQ ID NO. 12 in US20160355589 |
| TIGIT | VH | 2852 | SEQ ID NO. 124 in US20160355589 |
| TIGIT | VH | 2853 | SEQ ID NO. 125 in US20160355589 |
| TIGIT | VH | 2854 | SEQ ID NO. 126 in US20160355589 |
| TIGIT | VH | 2855 | SEQ ID NO. 127 in US20160355589 |
| TIGIT | VH | 2856 | SEQ ID NO. 128 in US20160355589 |
| TIGIT | VH | 2857 | SEQ ID NO. 129 in US20160355589 |
| TIGIT | VH | 2858 | SEQ ID NO. 13 in US20160355589 |
| TIGIT | VH | 2859 | SEQ ID NO. 136 in US20160355589 |
| TIGIT | VH | 2860 | SEQ ID NO. 138 in US20160355589 |
| TIGIT | VH | 2861 | SEQ ID NO. 14 in US20160355589 |
| TIGIT | VH | 2862 | SEQ ID NO. 143 in US20160355589 |
| TIGIT | VH | 2863 | SEQ ID NO. 144 in US20160355589 |
| TIGIT | VH | 2864 | SEQ ID NO. 149 in US20160355589 |
| TIGIT | VH | 2865 | SEQ ID NO. 15 in US20160355589 |
| TIGIT | VH | 2866 | SEQ ID NO. 150 in US20160355589 |
| TIGIT | VH | 2867 | SEQ ID NO. 16 in US20160355589 |
| TIGIT | VH | 2868 | SEQ ID NO. 17 in US20160355589 |
| TIGIT | VH | 2869 | SEQ ID NO. 18 in US20160355589 |
| TIGIT | VH | 2870 | SEQ ID NO. 19 in US20160355589 |
| TIGIT | VH | 2871 | SEQ ID NO. 20 in US20160355589 |
| TIGIT | VH | 2872 | SEQ ID NO. 21 in US20160355589 |
| TIGIT | VH | 2873 | SEQ ID NO. 22 in US20160355589 |
| TIGIT | VH | 2874 | SEQ ID NO. 23 in US20160355589 |
| TIGIT | VH | 2875 | SEQ ID NO. 24 in US20160355589 |
| TIGIT | VH | 2876 | SEQ ID NO. 37 in US20160355589 |
| TIGIT | VH | 2877 | SEQ ID NO. 38 in US20160355589 |
| TIGIT | VH | 2878 | SEQ ID NO. 39 in US20160355589 |
| TIGIT | VH | 2879 | SEQ ID NO. 40 in US20160355589 |
| TIGIT | VH | 2880 | SEQ ID NO. 41 in US20160355589 |
| TIGIT | VH | 2881 | SEQ ID NO. 42 in US20160355589 |
| TIGIT | VH | 2882 | SEQ ID NO. 43 in US20160355589 |
| TIGIT | VH | 2883 | SEQ ID NO. 44 in US20160355589 |
| TIGIT | VH | 2884 | SEQ ID NO. 45 in US20160355589 |
| TIGIT | VH | 2885 | SEQ ID NO. 46 in US20160355589 |
| TIGIT | VH | 2886 | SEQ ID NO. 47 in US20160355589 |
| TIGIT | VH | 2887 | SEQ ID NO. 63 in US20160355589 |
| TIGIT | VH | 2888 | SEQ ID NO. 94 in US20160355589 |
| TIGIT | VH | 2889 | SEQ ID NO. 7 in US20160355589 |
| TIGIT | VH | 2890 | SEQ ID NO. 9 in US20160355589 |
| TIM3 | VH | 2891 | SEQ ID NO: 82 in WO2013006490 |
| TIM3 | VH | 2892 | SEQ ID NO: 13 in WO2016179319A1 |
| TIM3 | VH | 2893 | SEQ ID NO: 21 in WO2016179319A1 |
| TIM3 | VH | 2894 | SEQ ID NO: 29 in WO2016179319A1 |
| TIM3 | VH | 2895 | SEQ ID NO: 37 in WO2016179319A1 |
| TIM3 | VH | 2896 | SEQ ID NO: 45 in WO2016179319A1 |
| TIM3 | VH | 2897 | SEQ ID NO: 5 in WO2016179319A1 |
| TIM3 | VH | 2898 | SEQ ID NO: 53 in WO2016179319A1 |
| TIM3 | VH | 2899 | SEQ ID NO: 61 in WO2016179319A1 |
| TIM3 | VH | 2900 | SEQ ID NO: 69 in WO2016179319A1 |
| TIM3 | VH | 2901 | SEQ ID NO: 77 in WO2016179319A1 |
| TIM3 | VH | 2902 | SEQ ID NO: 85 in WO2016179319A1 |
| TIM3 | VH | 2903 | SEQ ID NO: 93 in WO2016179319A1 |
| Tissue factor | VH | 2904 | SEQ ID NO 10 in WO2004094475 |
| Tissue factor | VH | 2905 | SEQ ID NO 19 in WO2004094475 |
| Tissue factor | VH | 2906 | SEQ ID NO 23 in WO2004094475 |
| Tissue factor | VH | 2907 | SEQ ID NO 27 in WO2004094475 |
| Tissue factor | VH | 2908 | SEQ ID NO 29 in WO2004094475 |
| Tissue factor | VH | 2909 | SEQ ID NO 6 in WO2004094475 |
| Tissue factor | VH | 2910 | SEQ ID NO: 38 in US20160333114A1 |
| Tn Glycopeptide | VH | 2911 | SEQ ID NO. 20 in WO2015120180 |
| Tn Glycopeptide | VH | 2912 | SEQ ID NO. 19 in WO2015120180 |
| TRBC1 | VH | 2913 | SEQ ID NO. 1 in WO2015132598 |
| Trophoblast Glycoprotein 5T4 | VH | 2914 | SEQ ID NO. 17 in WO2016034666A1 |
| Trophoblast Glycoprote in 5T4VH | VH | 2915 | SEQ ID NO. 13 in WO2016034666A1 |
| Trophoblast Glycoprotein 5T4VH | VH | 2916 | SEQ ID NO. 15 in WO2016034666A1 |
| Trophoblast Glycoprotein 5T4VH | VH | 2917 | SEQ ID NO. 11 in WO2016034666A1 |
| uPAR | VH | 2918 | SEQ ID NO: 72 in US20160333114A1 |
| V2 | VH | 2919 | SEQ ID NO: 11 in US20160194375A1 |
| VEGF | VH | 2920 | SEQ ID NO 4 in WO2000034337 |
| VEGF | VH | 2921 | SEQ ID NO 8 in WO2000034337 |

TABLE 10-continued

Variable Heavy and Light Chain Sequences

| Target | Antibody chain | SEQ ID NO | Source |
|---|---|---|---|
| VEGF | VH | 2922 | SEQ ID NO 12 in WO2006012688A1 |
| VEGF | VH | 2923 | SEQ ID NO 20 in WO2006012688A1 |
| VEGF | VH | 2924 | SEQ ID NO 4 in WO2006012688A1 |
| VEGF | VH | 2925 | SEQ ID NO 44 in WO2006012688A1 |
| VEGF | VH | 2926 | SEQ ID NO. 7 in US20030175276A1 |
| VEGF | VH | 2927 | US20160090427 SEQ ID NO: 152 |
| VEGF | VH | 2928 | US20160090427 SEQ ID NO: 153 |
| VEGF | VH | 2929 | US20160090427 SEQ ID NO: 154 |
| VEGF | VH | 2930 | US20160090427 SEQ ID NO: 155 |
| VEGF | VH | 2931 | US20160090427 SEQ ID NO: 156 |
| VEGF | VH | 2932 | US20160090427 SEQ ID NO: 157 |
| VEGF | VH | 2933 | US20160090427 SEQ ID NO: 158 |
| VEGF | VH | 2934 | US20160090427 SEQ ID NO: 159 |
| VEGFR2 | VH | 2935 | SEQ ID NO. 100 In WO2017004254 |
| VEGFR2 | VH | 2936 | SEQ ID NO. 101 In WO2017004254 |
| VEGFR2 | VH | 2937 | SEQ ID NO. 102 In WO2017004254 |
| VEGFR2 | VH | 2938 | SEQ ID NO. 103 In WO2017004254 |
| VEGFR2 | VH | 2939 | SEQ ID NO. 114 in WO2017004254 |
| VEGFR2 | VH | 2940 | SEQ ID NO. 115 in WO2017004254 |
| VEGFR2 | VH | 2941 | SEQ ID NO. 116 in WO2017004254 |
| VEGFR2 | VH | 2942 | SEQ ID NO. 117 in WO2017004254 |
| VEGFR2 | VH | 2943 | SEQ ID NO. 118 in WO2017004254 |
| VEGFR2 | VH | 2944 | SEQ ID NO. 119 in WO2017004254 |
| VEGFR2 | VH | 2945 | SEQ ID NO. 120 in WO2017004254 |
| VEGFR2 | VH | 2946 | SEQ ID NO. 121 in WO2017004254 |
| VEGFR2 | VH | 2947 | SEQ ID NO. 122 in WO2017004254 |
| VEGFR2 | VH | 2948 | SEQ ID NO. 123 in WO2017004254 |
| VEGFR2 | VH | 2949 | SEQ ID NO. 124 in WO2017004254 |
| VEGFR2 | VH | 2950 | SEQ ID NO. 95 In WO2017004254 |
| VEGFR2 | VH | 2951 | SEQ ID NO. 96 In WO2017004254 |
| VEGFR2 | VH | 2952 | SEQ ID NO. 97 In WO2017004254 |
| VEGFR2 | VH | 2953 | SEQ ID NO. 98 In WO2017004254 |
| VEGFR2 | VH | 2954 | SEQ ID NO. 99 In WO2017004254 |
| VISTA | VH | 2955 | SEQ ID NO: 37 in WO2015097536 |
| VISTA | VH | 2956 | SEQ ID NO: 38 in WO2015097536 |
| VISTA | VH | 2957 | SEQ ID NO: 39 in WO2015097536 |
| VISTA | VH | 2958 | SEQ ID NO: 40 in WO2015097536 |
| VMS2 | VH | 2959 | FIG. 1 in WO2000058363 |
| WT1/HLA Bi Specific | VH | 2960 | SEQ ID NO. 104 in WO2015070061 |
| WT1/HLA Bi Specific | VH | 2961 | SEQ ID NO. 111 in WO2015070061 |
| WT1/HLA Bi Specific | VH | 2962 | SEQ ID NO. 128 in WO2015070061 |
| WT1/HLA Bi Specific | VH | 2963 | SEQ ID NO. 14 in WO2015070061 |
| WT1/HLA Bi Specific | VH | 2964 | SEQ ID NO. 32 in WO2015070061 |
| WT1/HLA Bi Specific | VH | 2965 | SEQ ID NO. 50 in WO2015070061 |
| WT1/HLA Bi Specific | VH | 2966 | SEQ ID NO. 68 in WO2015070061 |
| WT1/HLA Bi Specific | VH | 2967 | SEQ ID NO. 86 in WO2015070061 |
| CD19 | VH | 2968 | SEQ ID NO. 53 in WO2016120216 |
| CD19 | VH | 2969 | SEQ ID NO. 55 in WO2016120216 |
| CD20(Ofatumumab) | VH | 2970 | SEQ ID NO. 25 in US20170000900 |
| CD20(Rituximab) | VH | 2971 | SEQ ID NO. 24 in US20170000900 |
| CD20(Veltuzumab) | VH | 2972 | SEQ ID NO. 23 in US20170000900 |
| CD22 | VH | 2973 | SEQ ID NO. 3 in WO2013059593 |
| CD22 | VH | 2974 | SEQ ID NO. 4 in WO2013059593 |
| CD28 | VH | 2975 | SEQ ID NO. 19 in WO2015158868 |
| CD33 | VH | 2976 | SEQ ID NO. 65 in WO2016120216 |
| CD33 | VH | 2977 | SEQ ID NO. 67 in WO2016120216 |
| CD33 | VH | 2978 | SEQ ID NO. 69 in WO2016120216 |
| CD33 | VH | 2979 | SEQ ID NO. 71 in WO2016120216 |
| CD33 | VH | 2980 | SEQ ID NO. 77 in WO2016120216 |
| CD33 | VH | 2981 | SEQ ID NO. 79 in WO2016120216 |
| CD33 | VH | 2982 | SEQ ID NO. 81 in WO2016120216 |
| CD33 | VH | 2983 | SEQ ID NO. 83 in WO2016120216 |
| CD33 | VH | 2984 | SEQ ID NO. 84 in WO2016120216 |
| CD37 | VH | 2985 | SEQ ID NO. 11 in US20170000900 |
| CD37 | VH | 2986 | SEQ ID NO. 12 in US20170000900 |
| CD37 | VH | 2987 | SEQ ID NO. 18 in US20170000900 |
| CD73 | VH | 2988 | SEQ ID NO. 100 in US20160145350 |
| CD73 | VH | 2989 | SEQ ID NO. 103 in US20160145350 |
| CD73 | VH | 2990 | SEQ ID NO. 107 in US20160145350 |
| CD73 | VH | 2991 | SEQ ID NO. 109 in US20160145350 |
| CD73 | VH | 2992 | SEQ ID NO. 112 in US20160145350 |
| CD73 | VH | 2993 | SEQ ID NO. 114 in US20160145350 |
| CD73 | VH | 2994 | SEQ ID NO. 116 in US20160145350 |
| CD73 | VH | 2995 | SEQ ID NO. 119 in US20160145350 |
| CD73 | VH | 2996 | SEQ ID NO. 121 in US20160145350 |

TABLE 10-continued

Variable Heavy and Light Chain Sequences

| Target | Antibody chain | SEQ ID NO | Source |
|---|---|---|---|
| CD73 | VH | 2997 | SEQ ID NO. 16 in US20160145350 |
| CD73 | VH | 2998 | SEQ ID NO. 32 in US20160145350 |
| CD73 | VH | 2999 | SEQ ID NO. 4 in US20160145350 |
| CD73 | VH | 3000 | SEQ ID NO. 52 in US20160145350 |
| CD73 | VH | 3001 | SEQ ID NO. 60 in US20160145350 |
| CD73 | VH | 3002 | SEQ ID NO. 68 in US20160145350 |
| CD73 | VH | 3003 | SEQ ID NO. 80 in US20160145350 |
| CD73 | VH | 3004 | SEQ ID NO. 88 in US20160145350 |
| CD74 | VH | 3005 | SEQ ID NO. 23 in US20130171064 |
| CD74 | VH | 3006 | SEQ ID NO. 27 in US20130171064 |
| CD74 | VH | 3007 | SEQ ID NO. 30 in US20130171064 |
| CD74 | VH | 3008 | SEQ ID NO. 33 in US20130171064 |
| CLDN18.2 | VH | 3009 | SEQ ID No. 12 in US20160347815A1 |
| CLDN18.2 | VH | 3010 | SEQ ID No. 2 in US20160347815A1 |
| CSPG4 | VH | 3011 | SEQ ID NO. 10 in WO2016077638 |
| CSPG4 | VH | 3012 | SEQ ID NO. 16 in WO2016077638 |
| CSPG4 | VH | 3013 | SEQ ID NO. 18 in WO2016077638 |
| CSPG4 | VH | 3014 | SEQ ID NO. 4 in WO2016077638 |
| CSPG4 | VH | 3015 | SEQ ID NO. 6 in WO2016077638 |
| CSPG4 | VH | 3016 | SEQ ID NO. 8 in WO2016077638 |
| EGFRvIII | VH | 3017 | SEQ ID NO. 91 in WO2016120216 |
| EGFRvIII | VH | 3018 | SEQ ID NO. 93 in WO2016120216 |
| FAP | VH | 3019 | SEQ ID NO: 8 in US20160326265A1 |
| GD2 | VH | 3020 | SEQ ID NO. 17 in WO2016134284 |
| GPC3 | VH | 3021 | SEQ ID NO. 22 in WO2016049459 |
| GPC3 | VH | 3022 | SEQ ID NO: 12 in U.S. Pat. No. 9,409,994B2 |
| GPC3 | VH | 3023 | SEQ ID NO: 16 in U.S. Pat. No. 9,409,994B2 |
| GPC3 | VH | 3024 | SEQ ID NO: 20 in U.S. Pat. No. 9,409,994B2 |
| GPC3 | VH | 3025 | SEQ ID NO: 37 in U.S. Pat. No. 9,409,994B2 |
| GPC3 | VH | 3026 | SEQ ID NO: 8 in U.S. Pat. No. 9,409,994B2 |
| HER2 | VH | 3027 | SEQ ID NO. 19 in U.S. Pat. No. 9,518,118 |
| HER2 | VH | 3028 | SEQ ID NO. 24 in U.S. Pat. No. 9,518,118 |
| LAG3 | VH | 3029 | SEQ ID NO. 102 in US20150259420 |
| LAG3 | VH | 3030 | SEQ ID NO. 106 in US20150259420 |
| LAG3 | VH | 3031 | SEQ ID NO. 110 in US20150259420 |
| LAG3 | VH | 3032 | SEQ ID NO. 113 in US20150259420 |
| LAG3 | VH | 3033 | SEQ ID NO. 122 in US20150259420 |
| LAG3 | VH | 3034 | SEQ ID NO. 18 in US20150259420 |
| LAG3 | VH | 3035 | SEQ ID NO. 30 in US20150259420 |
| LAG3 | VH | 3036 | SEQ ID NO. 66 in US20150259420 |
| LAG3 | VH | 3037 | SEQ ID NO. 70 in US20150259420 |
| LAG3 | VH | 3038 | SEQ ID NO. 74 in US20150259420 |
| LAG3 | VH | 3039 | SEQ ID NO. 78 in US20150259420 |
| MCAM | VH | 3040 | SEQ ID NO. 101 in US20150259419 |
| MCAM | VH | 3041 | SEQ ID NO. 102 in US20150259419 |
| MCAM | VH | 3042 | SEQ ID NO. 103 in US20150259419 |
| MCAM | VH | 3043 | SEQ ID NO. 104 in US20150259419 |
| MCAM | VH | 3044 | SEQ ID NO. 105 in US20150259419 |
| MCAM | VH | 3045 | SEQ ID NO. 106 in US20150259419 |
| MCAM | VH | 3046 | SEQ ID NO. 107 in US20150259419 |
| Mesothelin | VH | 3047 | SEQ ID NO: 13 in US20160229919A1 |
| Mesothelin | VH | 3048 | SEQ ID NO: 17 in US20160229919A1 |
| Mesothelin | VH | 3049 | SEQ ID NO: 21 in US20160229919A1 |
| Mesothelin | VH | 3050 | SEQ ID NO: 25 in US20160229919A1 |
| Mesothelin | VH | 3051 | SEQ ID NO: 29 in US20160229919A1 |
| Mesothelin | VH | 3052 | SEQ ID NO: 9 in US20160229919A1 |
| MUC1C/ECD | VH | 3053 | SEQ ID NO: 15 in US20160340442A1 |
| MUC1C/ECD | VH | 3054 | SEQ ID NO: 19 in US20160340442A1 |
| MUC1C/ECD | VH | 3055 | SEQ ID NO: 23 in US20160340442A1 |
| MUC1C/ECD | VH | 3056 | SEQ ID NO: 60 in US20160340442A1 |
| MUC1C/ECD | VH | 3057 | SEQ ID NO: 64 in US20160340442A1 |
| MUC1C/ECD | VH | 3058 | SEQ ID NO: 68 in US20160340442A1 |
| MUC1C/ECD | VH | 3059 | SEQ ID NO: 72 in US20160340442A1 |
| NYBR1 | VH | 3060 | SEQ ID NO: 19 in US20160333422A1 |
| OTK3 | VH | 3061 | SEQ ID NO. 17 in WO2015158868 |
| OX40 | VH | 3062 | SEQ ID NO. 19 in U.S. Pat. No. 8,748,585 |
| OX40 | VH | 3063 | SEQ ID NO. 21 in U.S. Pat. No. 8,748,585 |
| OX40 | VH | 3064 | SEQ ID NO. 22 in U.S. Pat. No. 8,748,585 |
| OX40 | VH | 3065 | SEQ ID NO. 23 in U.S. Pat. No. 8,748,585 |
| OX40 | VH | 3066 | SEQ ID NO. 29 in U.S. Pat. No. 8,748,585 |
| OX40 | VH | 3067 | SEQ ID NO. 58 in U.S. Pat. No. 8,748,585 |
| OX40 | VH | 3068 | SEQ ID NO. 59 in U.S. Pat. No. 8,748,585 |
| OX40 | VH | 3069 | SEQ ID NO. 7 in U.S. Pat. No. 8,748,585 |
| OX40 | VH | 3070 | SEQ ID NO. 77 in U.S. Pat. No. 8,748,585 |
| OX40 | VH | 3071 | SEQ ID NO. 78 in U.S. Pat. No. 8,748,585 |

TABLE 10-continued

Variable Heavy and Light Chain Sequences

| Target | Antibody chain | SEQ ID NO | Source |
|---|---|---|---|
| OX40 | VH | 3072 | SEQ ID NO. 79 in U.S. Pat. No. 8,748,585 |
| OX40 | VH | 3073 | SEQ ID NO. 80 in U.S. Pat. No. 8,748,585 |
| PDL1 | VH | 3074 | US20160108123 SEQ ID NO: 358 |
| PDL1 | VH | 3075 | US20160108123 SEQ ID NO: 56 |
| PDL1 | VH | 3076 | US20160108123 SEQ ID NO: 64 |
| PTK7 | VH | 3077 | SEQ ID NO. 1 in US20150315293 |
| PTK7 | VH | 3078 | SEQ ID NO. 25 in US20150315293 |
| PTK7 | VH | 3079 | SEQ ID NO. 49 in US20150315293 |
| TIM3 | VH | 3080 | SEQ ID NO. 102 in US20150086574 |
| TIM3 | VH | 3081 | SEQ ID NO. 112 in US20150086574 |
| TIM3 | VH | 3082 | SEQ ID NO. 12 in US20150086574 |
| TIM3 | VH | 3083 | SEQ ID NO. 2 in US20150086574 |
| TIM3 | VH | 3084 | SEQ ID NO. 22 in US20150086574 |
| TIM3 | VH | 3085 | SEQ ID NO. 32 in US20150086574 |
| TIM3 | VH | 3086 | SEQ ID NO. 42 in US20150086574 |
| TIM3 | VH | 3087 | SEQ ID NO. 52 in US20150086574 |
| TIM3 | VH | 3088 | SEQ ID NO. 62 in US20150086574 |
| TIM3 | VH | 3089 | SEQ ID NO. 72 in US20150086574 |
| TIM3 | VH | 3090 | SEQ ID NO. 82 in US20150086574 |
| TIM3 | VH | 3091 | SEQ ID NO. 92 in US20150086574 |
| CD20(Obinutuzumab) | VH | 3092 | SEQ ID NO. 26 in US20170000900 |
| GD2 | | 3093 | SEQ ID NO. 1 in US20130216528 |
| GPDL1 | VH | 3094 | US20160108123 SEQ ID NO: 20 |
| CD19 | VK | 3095 | SEQ ID NO: 13 US20160319020 |
| CD19 | VK | 3096 | SEQ ID NO: 6 US20160319020 |
| hBAT1 | VL | 3097 | SEQ ID NO. 1 in WO2013014668 |
| hBAT1 | VL | 3098 | SEQ ID NO. 2 in WO2013014668 |
| hBAT1 | VL | 3099 | SEQ ID NO. 3 in WO2013014668 |
| hBAT1 | VL | 3100 | SEQ ID NO. 4 in WO2013014668 |
| AGR2 | VL | 3101 | SEQ ID NO. 11 in WO2016040321 |
| AGR2 | VL | 3102 | SEQ ID NO. 19 in WO2016040321 |
| ALK | VL | 3103 | SEQ ID NO: 10 in US20160280798A1 |
| ALK | VL | 3104 | SEQ ID NO: 12 in US20160280798A1 |
| ALK | VL | 3105 | SEQ ID NO: 14 in US20160280798A1 |
| ALK | VL | 3106 | SEQ ID NO: 16 in US20160280798A1 |
| ALK | VL | 3107 | SEQ ID NO: 2 in US20160280798A1 |
| ALK | VL | 3108 | SEQ ID NO: 4 in US20160280798A1 |
| ALK | VL | 3109 | SEQ ID NO: 6 in US20160280798A1 |
| ALK | VL | 3110 | SEQ ID NO: 8 in US20160280798A1 |
| AMC | VL | 3111 | SEQ ID NO. 27 in WO2016161390 |
| AMC | VL | 3112 | SEQ ID NO. 28 in WO2016161390 |
| AMC | VL | 3113 | SEQ ID NO. 29 in WO2016161390 |
| AMC | VL | 3114 | SEQ ID NO. 31 in WO2016161390 |
| AMC | VL | 3115 | SEQ ID NO. 32 in WO2016161390 |
| AMC | VL | 3116 | SEQ ID NO. 33 in WO2016161390 |
| AMC | VL | 3117 | SEQ ID NO. 34 in WO2016161390 |
| AMC | VL | 3118 | SEQ ID NO. 35 in WO2016161390 |
| AMC | VL | 3119 | SEQ ID NO. 36 in WO2016161390 |
| ANG2 | VL | 3120 | SEQ ID NO. 2 in WO2015091655 |
| ANG2 | VL | 3121 | SEQ ID NO. 4 in WO2015091655 |
| APCDD1 | VL | 3122 | SEQ ID NO: 136 in WO2012019061 |
| APCDD1 | VL | 3123 | SEQ ID NO: 100 in WO2012019061 |
| APCDD1 | VL | 3124 | SEQ ID NO: 104 in WO2012019061 |
| APCDD1 | VL | 3125 | SEQ ID NO: 108 in WO2012019061 |
| APCDD1 | VL | 3126 | SEQ ID NO: 112 in WO2012019061 |
| APCDD1 | VL | 3127 | SEQ ID NO: 116 in WO2012019061 |
| APCDD1 | VL | 3128 | SEQ ID NO: 12 in WO2012019061 |
| APCDD1 | VL | 3129 | SEQ ID NO: 120 in WO2012019061 |
| APCDD1 | VL | 3130 | SEQ ID NO: 124 in WO2012019061 |
| APCDD1 | VL | 3131 | SEQ ID NO: 128 in WO2012019061 |
| APCDD1 | VL | 3132 | SEQ ID NO: 132 in WO2012019061 |
| APCDD1 | VL | 3133 | SEQ ID NO: 16 in WO2012019061 |
| APCDD1 | VL | 3134 | SEQ ID NO: 8 in WO2012019061 |
| APRIL | VL | 3135 | SEQ ID NO. 20 in US20160264674 |
| APRIL | VL | 3136 | SEQ ID NO. 22 in US20160264674 |
| APRIL | VL | 3137 | SEQ ID NO. 24 in US20160264674 |
| APRIL | VL | 3138 | SEQ ID NO. 26 in US20160264674 |
| APRIL | VL | 3139 | SEQ ID NO. 28 in US20160264674 |
| APRIL | VL | 3140 | SEQ ID NO. 30 in US20160264674 |
| APRIL | VL | 3141 | SEQ ID NO. 4 in US20160264674 |
| APRIL | VL | 3142 | SEQ ID NO. 50 in US20160264674 |
| AXL | VL | 3143 | SEQ ID NO. 22 in WO2016097370 |
| AXL | VL | 3144 | SEQ ID NO. 4 in WO2016097370 |
| B2MG | VL | 3145 | SEQIDNO: 29 in WO2016126213A1 |
| B7H1 | VL | 3146 | SEQ ID NO: 17 in US20130034559 |

TABLE 10-continued

Variable Heavy and Light Chain Sequences

| Target | Antibody chain | SEQ ID NO | Source |
|---|---|---|---|
| B7H1 | VL | 3147 | SEQ ID NO: 37 in US20130034559 |
| B7H1 | VL | 3148 | SEQ ID NO: 47 in US20130034559 |
| B7H1 | VL | 3149 | SEQ ID NO: 57 in US20130034559 |
| B7H1 | VL | 3150 | SEQ ID NO: 7 in US20130034559 |
| B7H1 | VL | 3151 | SEQ ID NO: 77 in US20130034559 |
| B7H1 | VL | 3152 | SEQ ID NO: 27 in US20130034559 |
| B7H1 | VL | 3153 | SEQ ID NO: 67 in US20130034559 |
| B7H3 | VL | 3154 | SEQ ID NO. 1 in WO2016033225 |
| B7H3 | VL | 3155 | SEQ ID NO. 2 in WO2016033225 |
| B7H3 | VL | 3156 | SEQ ID NO. 3 in WO2016033225 |
| B7H3 | VL | 3157 | SEQ ID NO. 4 in WO2016033225 |
| B7H3 | VL | 3158 | SEQ ID NO. 5 in WO2016033225 |
| B7H3 | VL | 3159 | SEQ ID NO. 6 in WO2016033225 |
| B7H3 | VL | 3160 | SEQ ID NO. 7 in WO2016033225 |
| B7H3 | VL | 3161 | SEQ ID NO. 8 in WO2016033225 |
| B7H3(CD276) | VL | 3162 | SEQ ID NO. 18 in WO2016044383 |
| B7H3(CD276) | VL | 3163 | SEQ ID NO. 27 in WO2016044383 |
| B7H3(CD276) | VL | 3164 | SEQ ID NO. 8 in WO2016044383 |
| B7H4 | VL | 3165 | SEQ ID NO. 104 in US20160159910 |
| B7H4 | VL | 3166 | SEQ ID NO. 11 in US20160159910 |
| B7H4 | VL | 3167 | SEQ ID NO. 126 in US20160159910 |
| B7H4 | VL | 3168 | SEQ ID NO. 134 in US20160159910 |
| B7H4 | VL | 3169 | SEQ ID NO. 138 in US20160159910 |
| B7H4 | VL | 3170 | SEQ ID NO. 19 in US20160159910 |
| B7H4 | VL | 3171 | SEQ ID NO. 27 in US20160159910 |
| B7H4 | VL | 3172 | SEQ ID NO. 3 in US20160159910 |
| B7H4 | VL | 3173 | SEQ ID NO. 35 in US20160159910 |
| B7H4 | VL | 3174 | SEQ ID NO. 55 in US20160159910 |
| B7H4 | VL | 3175 | SEQ ID NO. 93 in US20160159910 |
| B7H4 | VL | 3176 | SEQ ID NO. 95 in US20160159910 |
| B7H4 | VL | 3177 | SEQ ID NO. 97 in US20160159910 |
| B7H4 | VL | 3178 | SEQ ID NO. 98 in US20160159910 |
| B7H4 | VL | 3179 | SEQ ID NO. 145 in US20160159910 |
| B7H4 | VL | 3180 | SEQ ID NO. 146 in US20160159910 |
| B7H4 | VL | 3181 | SEQ ID NO. 147 in US20160159910 |
| B7H4 | VL | 3182 | SEQ ID NO. 148 in US20160159910 |
| B7H4 | VL | 3183 | SEQ ID NO. 29 in WO2016160620 |
| B7H4 | VL | 3184 | SEQ ID NO. 31 in WO2016160620 |
| B7H4 | VL | 3185 | SEQ ID NO. 33 in WO2016160620 |
| BCMA | VL | 3186 | SEQ ID NO: 25 in WO2016168773A3 |
| BCMA | VL | 3187 | SEQ ID NO: 42 in WO2016097231 |
| BCMA | VL | 3188 | SEQ ID NO: 143 in WO2016168595A1 |
| BCMA | VL | 3189 | SEQ ID NO: 149 in WO2016168595A1 |
| BCMA | VL | 3190 | SEQ ID NO: 155 in WO2016168595A1 |
| BCMA | VL | 3191 | SEQ ID NO: 161 in WO2016168595A1 |
| BCMA | VL | 3192 | SEQ ID NO: 167 in WO2016168595A1 |
| BCMA | VL | 3193 | SEQ ID NO: 173 in WO2016168595A1 |
| BCMA | VL | 3194 | SEQ ID NO: 179 in WO2016168595A1 |
| BCMA | VL | 3195 | SEQ ID NO: 185 in WO2016168595A1 |
| BCMA | VL | 3196 | SEQ ID NO: 191 in WO2016168595A1 |
| BCMA | VL | 3197 | SEQ ID NO: 197 in WO2016168595A1 |
| BCMA | VL | 3198 | SEQ ID NO: 203 in WO2016168595A1 |
| BCMA | VL | 3199 | SEQ ID NO: 209 in WO2016168595A1 |
| BCMA | VL | 3200 | SEQ ID NO: 215 in WO2016168595A1 |
| BCMA | VL | 3201 | SEQ ID NO: 221 in WO2016168595A1 |
| BCMA | VL | 3202 | SEQ ID NO: 227 in WO2016168595A1 |
| BCMA | VL | 3203 | SEQ ID NO: 233 in WO2016168595A1 |
| BCMA | VL | 3204 | SEQ ID NO: 239 in WO2016168595A1 |
| BCMA | VL | 3205 | SEQ ID NO: 245 in WO2016168595A1 |
| BCMA | VL | 3206 | SEQ ID NO: 251 in WO2016168595A1 |
| BCMA | VL | 3207 | SEQ ID NO: 257 in WO2016168595A1 |
| BCMA | VL | 3208 | SEQ ID NO: 263 in WO2016168595A1 |
| BCMA | VL | 3209 | SEQ ID NO: 269 in WO2016168595A1 |
| BCMA | VL | 3210 | SEQ ID NO: 275 in WO2016168595A1 |
| BCMA | VL | 3211 | SEQ ID NO: 281 in WO2016168595A1 |
| BCMA | VL | 3212 | SEQ ID NO: 287 in WO2016168595A1 |
| BCMA | VL | 3213 | SEQ ID NO: 293 in WO2016168595A1 |
| BCMA | VL | 3214 | SEQ ID NO: 299 in WO2016168595A1 |
| BCMA | VL | 3215 | SEQ ID NO: 305 in WO2016168595A1 |
| BCMA | VL | 3216 | SEQ ID NO: 311 in WO2016168595A1 |
| BCMA | VL | 3217 | SEQ ID NO: 317 in WO2016168595A1 |
| BCMA | VL | 3218 | SEQ ID NO: 323 in WO2016168595A1 |
| BCMA | VL | 3219 | SEQ ID NO: 329 in WO2016168595A1 |
| BCMA | VL | 3220 | SEQ ID NO: 335 in WO2016168595A1 |
| BCMA | VL | 3221 | SEQ ID NO: 341 in WO2016168595A1 |

TABLE 10-continued

Variable Heavy and Light Chain Sequences

| Target | Antibody chain | SEQ ID NO | Source |
|---|---|---|---|
| BCMA | VL | 3222 | SEQ ID NO: 347 in WO2016168595A1 |
| BCMA | VL | 3223 | SEQ ID NO: 353 in WO2016168595A1 |
| BCMA | VL | 3224 | SEQ ID NO. 192 WO2016014565 |
| BCMA | VL | 3225 | SEQ ID NO. 193 WO2016014565 |
| BCMA | VL | 3226 | SEQ ID NO. 194 WO2016014565 |
| BCMA | VL | 3227 | SEQ ID NO. 195 WO2016014565 |
| BCMA | VL | 3228 | SEQ ID NO. 196 WO2016014565 |
| BCMA | VL | 3229 | SEQ ID NO. 197 WO2016014565 |
| BCMA | VL | 3230 | SEQ ID NO. 198 WO2016014565 |
| BCMA | VL | 3231 | SEQ ID NO. 199 WO2016014565 |
| BCMA | VL | 3232 | SEQ ID NO. 200 WO2016014565 |
| BCMA | VL | 3233 | SEQ ID NO. 201 WO2016014565 |
| BCMA | VL | 3234 | SEQ ID NO. 204 WO2016014565 |
| BCMA | VL | 3235 | SEQ ID NO. 205 WO2016014565 |
| BCMA | VL | 3236 | SEQ ID NO. 207 WO2016014565 |
| BCMA | VL | 3237 | SEQ ID NO. 208 WO2016014565 |
| BCMA | VL | 3238 | SEQ ID NO. 211 WO2016014565 |
| BCMA | VL | 3239 | SEQ ID NO. 259 WO2016014565 |
| BCMA | VL | 3240 | SEQ ID NO. 260 WO2016014565 |
| BCMA | VL | 3241 | SEQ ID NO. 84 WO2016014565 |
| BCMA | VL | 3242 | SEQ ID NO. 85 WO2016014565 |
| BCMA | VL | 3243 | SEQ ID NO. 86 WO2016014565 |
| BCMA | VL | 3244 | SEQ ID NO. 87 WO2016014565 |
| BCMA | VL | 3245 | SEQ ID NO. 88 WO2016014565 |
| BCMA | VL | 3246 | SEQ ID NO. 89 WO2016014565 |
| BCMA | VL | 3247 | SEQ ID NO. 90 WO2016014565 |
| BCMA | VL | 3248 | SEQ ID NO. 91 WO2016014565 |
| BCMA | VL | 3249 | SEQ ID NO. 92 WO2016014565 |
| BCMA | VL | 3250 | SEQ ID NO. 93 WO2016014565 |
| BCMA | VL | 3251 | SEQ ID NO. 94 WO2016014565 |
| BCMA | VL | 3252 | SEQ ID NO. 95 WO2016014565 |
| BCMA | VL | 3253 | SEQ ID NO. 96 WO2016014565 |
| BCMA | VL | 3254 | SEQ ID NO. 97 WO2016014565 |
| BCMA | VL | 3255 | SEQ ID NO. 98 WO2016014565 |
| BCMA | VL | 3256 | SEQ ID NO: 53 in WO2016187349A1 |
| BCMA | VL | 3257 | SEQ ID NO: 7 in WO2016094304A3 |
| BCMA | VL | 3258 | SEQ ID NO. 10 in WO2016090320 |
| BCMA | VL | 3259 | SEQ ID NO. 100 in WO2016120216 |
| BCMA | VL | 3260 | SEQ ID NO. 102 in WO2016120216 |
| BCMA | VL | 3261 | SEQ ID NO. 12 in WO2015158671A1 |
| BCMA | VL | 3262 | SEQ ID NO. 14 in WO2015158671A1 |
| BCMA | VL | 3263 | SEQ ID NO. 14 in WO2016090320 |
| BCMA | VL | 3264 | SEQ ID NO. 16 in WO2015158671A1 |
| BCMA | VL | 3265 | SEQ ID NO. 175 in WO2016120216 |
| BCMA | VL | 3266 | SEQ ID NO. 18 in WO2015158671A1 |
| BCMA | VL | 3267 | SEQ ID NO. 18 in WO2016090320 |
| BCMA | VL | 3268 | SEQ ID NO. 2 in WO2016090320 |
| BCMA | VL | 3269 | SEQ ID NO. 22 in WO2016090320 |
| BCMA | VL | 3270 | SEQ ID NO. 26 in WO2016090320 |
| BCMA | VL | 3271 | SEQ ID NO. 30 in WO2016090320 |
| BCMA | VL | 3272 | SEQ ID NO. 34 in WO2016090320 |
| BCMA | VL | 3273 | SEQ ID NO. 38 in WO2016090320 |
| BCMA | VL | 3274 | SEQ ID NO. 42 in WO2016090320 |
| BCMA | VL | 3275 | SEQ ID NO. 46 in WO2016090320 |
| BCMA | VL | 3276 | SEQ ID NO. 50 in WO2016090320 |
| BCMA | VL | 3277 | SEQ ID NO. 54 in WO2016090320 |
| BCMA | VL | 3278 | SEQ ID NO. 58 in WO2016090320 |
| BCMA | VL | 3279 | SEQ ID NO. 6 in WO2016090320 |
| BCMA | VL | 3280 | SEQ ID NO. 62 in WO2016090320 |
| BCMA | VL | 3281 | SEQ ID NO. 66 in WO2016090320 |
| BCMA | VL | 3282 | SEQ ID NO. 7 in WO2016014789 |
| BCMA | VL | 3283 | SEQ ID NO. 8 in WO2016014789 |
| BCMA | VL | 3284 | SEQ ID NO. 9 in WO2016014789 |
| BCMA | VL | 3285 | SEQ ID NO. 96 in WO2016120216 |
| BCMA | VL | 3286 | SEQ ID NO. 98 in WO2016120216 |
| BCMA | VL | 3287 | SEQ ID NO: 14 in WO2016168766A1 |
| CA19.9 | VL | 3288 | SEQ ID NO: 118 in US20160333114A1 |
| Campath1 | VL | 3289 | SEQ ID NO: 31 in US20160333114A1 |
| Campath1 | VL | 3290 | SEQ ID NO: 33 in US20160333114A1 |
| CD105 | VL | 3291 | SEQ ID NO. 1 in WO2014039682 |
| CD105 | VL | 3292 | SEQ ID NO. 17 in WO2014039682 |
| CD105 | VL | 3293 | SEQ ID NO. 20 in WO2014039682 |
| CD105 | VL | 3294 | SEQ ID NO. 22 in WO2014039682 |
| CD105 | VL | 3295 | SEQ ID NO. 23 in WO2014039682 |
| CD123 | VL | 3296 | SEQ ID NO. 11 in WO2016120220 |

TABLE 10-continued

Variable Heavy and Light Chain Sequences

| Target | Antibody chain | SEQ ID NO | Source |
|---|---|---|---|
| CD123 | VL | 3297 | SEQ ID NO. 12 in WO2015140268A1 |
| CD123 | VL | 3298 | SEQ ID NO. 16 in WO2015140268A1 |
| CD123 | VL | 3299 | SEQ ID NO. 18 in WO2015140268A1 |
| CD123 | VL | 3300 | SEQ ID NO. 18 in WO2016120220 |
| CD123 | VL | 3301 | SEQ ID NO. 19 in WO2015140268A1 |
| CD123 | VL | 3302 | SEQ ID NO. 19 in WO2016120220 |
| CD123 | VL | 3303 | SEQ ID NO. 20 in WO2016120220 |
| CD123 | VL | 3304 | SEQ ID NO. 21 in WO2016120220 |
| CD123 | VL | 3305 | SEQ ID NO. 22 in WO2015140268A1 |
| CD123 | VL | 3306 | SEQ ID NO. 22 in WO2016120220 |
| CD123 | VL | 3307 | SEQ ID NO. 23 in WO2016120220 |
| CD123 | VL | 3308 | SEQ ID NO: 275 in WO2016028896 |
| CD123 | VL | 3309 | SEQ ID NO: 276 in WO2016028896 |
| CD123 | VL | 3310 | SEQ ID NO: 277 in WO2016028896 |
| CD123 | VL | 3311 | SEQ ID NO: 278 in WO2016028896 |
| CD123 | VL | 3312 | SEQ ID NO: 307 in WO2016028896 |
| CD123 | VL | 3313 | SEQ ID NO: 308 in WO2016028896 |
| CD123 | VL | 3314 | SEQ ID NO: 309 in WO2016028896 |
| CD123 | VL | 3315 | SEQ ID NO: 310 in WO2016028896 |
| CD123 | VL | 3316 | SEQ ID NO: 5 in US20160333108A1 |
| CD123 | VL | 3317 | WO2016120220 9No SEQ ID NO. |
| CD123 | VL | 3318 | WO2016120220 9No SEQ ID NO. |
| CD123 | VL | 3319 | WO2016120220 9No SEQ ID NO. |
| CD123 | VL | 3320 | WO2016120220 9No SEQ ID NO. |
| CD123 | VL | 3321 | WO2016120220 9No SEQ ID NO. |
| CD123 | VL | 3322 | WO2016120220 9No SEQ ID NO. |
| CD123 | VL | 3323 | WO2016120220 9No SEQ ID NO. |
| CD123 | VL | 3324 | WO2016120220 9No SEQ ID NO. |
| CD148 | VL | 3325 | SEQ ID NO 12 in WO2005118643 |
| CD148 | VL | 3326 | SEQ ID NO 16 in WO2005118643 |
| CD148 | VL | 3327 | SEQ ID NO 20 in WO2005118643 |
| CD148 | VL | 3328 | SEQ ID NO 24 in WO2005118643 |
| CD148 | VL | 3329 | SEQ ID NO 28 in WO2005118643 |
| CD148 | VL | 3330 | SEQ ID NO 32 in WO2005118643 |
| CD148 | VL | 3331 | SEQ ID NO 4 in WO2005118643 |
| CD148 | VL | 3332 | SEQ ID NO 8 in WO2005118643 |
| CD19 | VL | 3333 | SEQ ID NO: 27 in WO2016168773A3 |
| CD19 | VL | 3334 | SEQ ID NO: 31 in WO2016168773A3 |
| CD19 | VL | 3335 | SEQ ID NO: 49 in WO2016187349A1 |
| CD19 | VL | 3336 | SEQ ID NO. 11 in WO2016134284 |
| CD19 | VL | 3337 | SEQ ID NO. 194 in US20140134142A1 |
| CD19 | VL | 3338 | SEQ ID NO. 54 in WO2016120216 |
| CD19 | VL | 3339 | SEQ ID NO. 56 in WO2016120216 |
| CD19 | VL | 3340 | SEQ ID NO: 13 US20160152723 |
| CD19 | VL | 3341 | SEQ ID NO: 14 US20160152723 |
| CD19 | VL | 3342 | SEQ ID NO: 15 US20160152723 |
| CD19 | VL | 3343 | SEQ ID NO: 16 US20160152723 |
| CD19 | VL | 3344 | SEQ ID NO: 17 US20160152723 |
| CD19 | VL | 3345 | SEQ ID NO: 186 US20160152723 |
| CD19 | VL | 3346 | SEQ ID NO: 187 US20160152723 |
| CD19 | VL | 3347 | SEQ ID NO: 188 US20160152723 |
| CD19 | VL | 3348 | SEQ ID NO: 189 US20160152723 |
| CD19 | VL | 3349 | SEQ ID NO: 192 US20160152723 |
| CD19 | VL | 3350 | SEQ ID NO: 196 US20160152723 |
| CD19 | VL | 3351 | SEQ ID NO: 197 US20160152723 |
| CD19 | VL | 3352 | SEQ ID NO: 198 US20160152723 |
| CD19 | VL | 3353 | SEQ ID NO: 199 US20160152723 |
| CD19 | VL | 3354 | SEQ ID NO: 200 US20160152723 |
| CD19 | VL | 3355 | SEQ ID NO: 201 US20160152723 |
| CD19 | VL | 3356 | SEQ ID NO: 202 US20160152723 |
| CD19 | VL | 3357 | SEQ ID NO: 203 US20160152723 |
| CD19 | VL | 3358 | SEQ ID NO: 204 US20160152723 |
| CD19 | VL | 3359 | SEQ ID NO: 205 US20160152723 |
| CD19 | VL | 3360 | SEQ ID NO: 22 in US20160039942 |
| CD19 | VL | 3361 | SEQ ID NO: 63 in WO2016097231 |
| CD19 | VL | 3362 | SEQ ID NO: 64 US20160152723 |
| CD19 | VL | 3363 | SEQ ID NO: 66 US20160152723 |
| CD19 | VL | 3364 | SEQ ID NO: 67 US20160152723 |
| CD19 | VL | 3365 | SEQ ID NO: 68 US20160152723 |
| CD19 | VL | 3366 | SEQ ID NO: 69 US20160152723 |
| CD19 | VL | 3367 | SEQ ID NO: 70 US20160152723 |
| CD19 | VL | 3368 | SEQ ID NO: 71 US20160152723 |
| CD19 | VL | 3369 | SEQ ID NO: 91 US20160152723 |
| CD19 | VL | 3370 | SEQ ID NO. 3 in US20160145337A1 |
| CD19 | VL | 3371 | SEQ ID NO: 112 in US20160333114A1 |

TABLE 10-continued

Variable Heavy and Light Chain Sequences

| Target | Antibody chain | SEQ ID NO | Source |
|---|---|---|---|
| CD19 | VL | 3372 | SEQ ID NO: 114 in US20160333114A1 |
| CD2 | VL | 3373 | SEQ ID NO. 102 in WO2016122701 |
| CD2 | VL | 3374 | SEQ ID NO. 116 in WO2016122701 |
| CD20 | VL | 3375 | SEQ ID NO: 46 in WO2016097231 |
| CD20 | VL | 3376 | SEQ ID NO. 10 in WO2017004091 |
| CD20 | VL | 3377 | SEQ ID NO. 12 in WO2017004091 |
| CD20 | VL | 3378 | SEQ ID NO. 8 in WO2017004091 |
| CD20(Ofatumumab) | VL | 3379 | SEQ ID NO: 51 in US20160333114A1 |
| CD22 | VL | 3380 | SEQ ID NO: 17 in US20150239974 |
| CD22 | VL | 3381 | SEQ ID NO: 8 in US20150239974 |
| CD22 | VL | 3382 | SEQ ID NO. 7 in US20150299317 |
| CD22 | VL | 3383 | SEQ ID NO: 14 in US20150239974 |
| CD22 | VL | 3384 | SEQ ID NO: 15 in US20150239974 |
| CD22 | VL | 3385 | SEQ ID NO: 681 in WO2016164731A90 |
| CD22 | VL | 3386 | SEQ ID NO: 682 in WO2016164731A91 |
| CD22 | VL | 3387 | SEQ ID NO: 683 in WO2016164731A92 |
| CD22 | VL | 3388 | SEQ ID NO: 684 in WO2016164731A93 |
| CD22 | VL | 3389 | SEQ ID NO: 685 in WO2016164731A94 |
| CD22 | VL | 3390 | SEQ ID NO: 686 in WO2016164731A95 |
| CD22 | VL | 3391 | SEQ ID NO: 687 in WO2016164731A96 |
| CD22 | VL | 3392 | SEQ ID NO: 688 in WO2016164731A97 |
| CD22 | VL | 3393 | SEQ ID NO: 690 in WO2016164731A99 |
| CD22 | VL | 3394 | SEQ ID NO: 740 in WO2016164731A52 |
| CD22 | VL | 3395 | SEQ ID NO: 741 in WO2016164731A53 |
| CD22 | VL | 3396 | SEQ ID NO: 742 in WO2016164731A54 |
| CD22 | VL | 3397 | SEQ ID NO: 743 in WO2016164731A55 |
| CD22 | VL | 3398 | SEQ ID NO: 744 in WO2016164731A56 |
| CD22 | VL | 3399 | SEQ ID NO: 745 in WO2016164731A57 |
| CD22 | VL | 3400 | SEQ ID NO: 746 in WO2016164731A58 |
| CD22 | VL | 3401 | SEQ ID NO: 747 in WO2016164731A59 |
| CD22 | VL | 3402 | SEQ ID NO: 748 in WO2016164731A60 |
| CD22 | VL | 3403 | SEQ ID NO: 749 in WO2016164731A61 |
| CD22 | VL | 3404 | SEQ ID NO: 750 in WO2016164731A62 |
| CD22 | VL | 3405 | SEQ ID NO: 752 in WO2016164731A64 |
| CD22 | VL | 3406 | SEQ ID NO: 753 in WO2016164731A65 |
| CD22 | VL | 3407 | SEQ ID NO: 754 in WO2016164731A66 |
| CD22 | VL | 3408 | SEQ ID NO: 755 in WO2016164731A67 |
| CD22 | VL | 3409 | SEQ ID NO: 756 in WO2016164731A68 |
| CD22 | VL | 3410 | SEQ ID NO: 757 in WO2016164731A69 |
| CD22 | VL | 3411 | SEQ ID NO: 758 in WO2016164731A70 |
| CD22 | VL | 3412 | SEQ ID NO: 759 in WO2016164731A71 |
| CD22 | VL | 3413 | SEQ ID NO: 760 in WO2016164731A72 |
| CD22 | VL | 3414 | SEQ ID NO: 761 in WO2016164731A73 |
| CD22 | VL | 3415 | SEQ ID NO: 762 in WO2016164731A74 |
| CD22 | VL | 3416 | SEQ ID NO: 763 in WO2016164731A75 |
| CD22 | VL | 3417 | SEQ ID NO: 764 in WO2016164731A76 |
| CD22 | VL | 3418 | SEQ ID NO: 765 in WO2016164731A77 |
| CD22 | VL | 3419 | SEQ ID NO: 766 in WO2016164731A78 |
| CD22 | VL | 3420 | SEQ ID NO: 767 in WO2016164731A79 |
| CD22 | VL | 3421 | SEQ ID NO: 768 in WO2016164731A80 |
| CD22 | VL | 3422 | SEQ ID NO: 769 in WO2016164731A81 |
| CD22 | VL | 3423 | SEQ ID NO: 770 in WO2016164731A82 |
| CD22 | VL | 3424 | SEQ ID NO: 771 in WO2016164731A83 |
| CD22 | VL | 3425 | SEQ ID NO: 772 in WO2016164731A84 |
| CD22 | VL | 3426 | SEQ ID NO: 773 in WO2016164731A85 |
| CD22 | VL | 3427 | SEQ ID NO: 774 in WO2016164731A86 |
| CD22 | VL | 3428 | SEQ ID NO: 775 in WO2016164731A87 |
| CD22 | VL | 3429 | SEQ ID NO: 776 in WO2016164731A88 |
| CD22 | VL | 3430 | SEQ ID NO: 777 in WO2016164731A89 |
| CD22 | VL | 3431 | SEQ ID NO: 202 in WO2016164731A2 |
| CD22(Epratuzumab) | VL | 3432 | SEQ ID NO. 124 in WO2016122701 |
| CD3 | VL | 3433 | SEQ ID NO. 104 in WO2016122701 |
| CD3 | VL | 3434 | SEQ ID NO: 13 in WO2016126213A1 |
| CD30 | VL | 3435 | SEQ ID NO. 13 in WO2016134284 |
| CD30 | VL | 3436 | SEQ ID NO. 15 in WO2016134284 |
| CD324 | VL | 3437 | SEQ ID NO. 20 in U.S. Pat. No. 9,534,058 |
| CD324 | VL | 3438 | SEQ ID NO. 22 in U.S. Pat. No. 9,534,058 |
| CD324 | VL | 3439 | SEQ ID NO. 24 in U.S. Pat. No. 9,534,058 |
| CD324 | VL | 3440 | SEQ ID NO. 26 in U.S. Pat. No. 9,534,058 |
| CD324 | VL | 3441 | SEQ ID NO. 28 in U.S. Pat. No. 9,534,058 |
| CD324 | VL | 3442 | SEQ ID NO. 30 in U.S. Pat. No. 9,534,058 |
| CD324 | VL | 3443 | SEQ ID NO. 32 in U.S. Pat. No. 9,534,058 |
| CD324 | VL | 3444 | SEQ ID NO. 34 in U.S. Pat. No. 9,534,058 |
| CD324 | VL | 3445 | SEQ ID NO. 36 in U.S. Pat. No. 9,534,058 |
| CD324 | VL | 3446 | SEQ ID NO. 38 in U.S. Pat. No. 9,534,058 |

TABLE 10-continued

Variable Heavy and Light Chain Sequences

| Target | Antibody chain | SEQ ID NO | Source |
|---|---|---|---|
| CD324 | VL | 3447 | SEQ ID NO. 40 in U.S. Pat. No. 9,534,058 |
| CD324 | VL | 3448 | SEQ ID NO. 42 in U.S. Pat. No. 9,534,058 |
| CD324 | VL | 3449 | SEQ ID NO. 44 in U.S. Pat. No. 9,534,058 |
| CD324 | VL | 3450 | SEQ ID NO. 46 in U.S. Pat. No. 9,534,058 |
| CD324 | VL | 3451 | SEQ ID NO. 48 in U.S. Pat. No. 9,534,058 |
| CD324 | VL | 3452 | SEQ ID NO. 50 in U.S. Pat. No. 9,534,058 |
| CD324 | VL | 3453 | SEQ ID NO. 52 in U.S. Pat. No. 9,534,058 |
| CD324 | VL | 3454 | SEQ ID NO. 54 in U.S. Pat. No. 9,534,058 |
| CD324 | VL | 3455 | SEQ ID NO. 56 in U.S. Pat. No. 9,534,058 |
| CD324 | VL | 3456 | SEQ ID NO. 58 in U.S. Pat. No. 9,534,058 |
| CD324 | VL | 3457 | SEQ ID NO. 60 in U.S. Pat. No. 9,534,058 |
| CD324 | VL | 3458 | SEQ ID NO. 62 in U.S. Pat. No. 9,534,058 |
| CD324 | VL | 3459 | SEQ ID NO. 64 in U.S. Pat. No. 9,534,058 |
| CD324 | VL | 3460 | SEQ ID NO. 66 in U.S. Pat. No. 9,534,058 |
| CD324 | VL | 3461 | SEQ ID NO. 68 in U.S. Pat. No. 9,534,058 |
| CD324 | VL | 3462 | SEQ ID NO. 70 in U.S. Pat. No. 9,534,058 |
| CD32B | VL | 3463 | SEQ ID NO. 126 in WO2016122701 |
| CD33 | VL | 3464 | SEQ ID NO. 12 in WO2015150526A2 |
| CD33 | VL | 3465 | SEQ ID NO. 14 in WO2015150526A2 |
| CD33 | VL | 3466 | SEQ ID NO. 16 in WO2015150526A2 |
| CD33 | VL | 3467 | SEQ ID NO. 18 in WO2015150526A2 |
| CD33 | VL | 3468 | SEQ ID NO. 66 in WO2016014576 |
| CD33 | VL | 3469 | SEQ ID NO. 66 in WO2016120216 |
| CD33 | VL | 3470 | SEQ ID NO. 67 in WO2016014576 |
| CD33 | VL | 3471 | SEQ ID NO. 68 in WO2016014576 |
| CD33 | VL | 3472 | SEQ ID NO. 68 in WO2016120216 |
| CD33 | VL | 3473 | SEQ ID NO. 69 in WO2016014576 |
| CD33 | VL | 3474 | SEQ ID NO. 70 in WO2016014576 |
| CD33 | VL | 3475 | SEQ ID NO. 70 in WO2016120216 |
| CD33 | VL | 3476 | SEQ ID NO. 71 in WO2016014576 |
| CD33 | VL | 3477 | SEQ ID NO. 72 in WO2016014576 |
| CD33 | VL | 3478 | SEQ ID NO. 72 in WO2016120216 |
| CD33 | VL | 3479 | SEQ ID NO. 73 in WO2016014576 |
| CD33 | VL | 3480 | SEQ ID NO. 74 in WO2016014576 |
| CD33 | VL | 3481 | SEQ ID NO. 78 in WO2016120216 |
| CD33 | VL | 3482 | SEQ ID NO. 80 in WO2016120216 |
| CD33 | VL | 3483 | SEQ ID NO. 82 in WO2016120216 |
| CD37 | VL | 3484 | SEQ ID NO. 14 in US20170000900 |
| CD37 | VL | 3485 | SEQ ID NO. 15 in US20170000900 |
| CD38 | VL | 3486 | SEQ ID NO. 1 in WO2009080830 |
| CD38 | VL | 3487 | SEQ ID No. 11 in WO2015121454 |
| CD3s | VL | 3488 | SEQ ID NO: 8 in WO2014144722A2 |
| CD40 | VL | 3489 | SEQ ID NO. 2 in WO2016069919 |
| CD40 | VL | 3490 | SEQ ID NO. 6 in WO2015091655 |
| CD45 | VL | 3491 | SEQ ID NO: 25 in WO2016126213A1 |
| CD46 | VL | 3492 | SEQ ID NO: 41 in WO2012031273 |
| CD46 | VL | 3493 | SEQ ID NO: 61 in WO2012031273 |
| CD46 | VL | 3494 | SEQ ID NO: 21 in WO2012031273 |
| CD46 | VL | 3495 | SEQ ID NO: 25 in WO2012031273 |
| CD46 | VL | 3496 | SEQ ID NO: 29 in WO2012031273 |
| CD46 | VL | 3497 | SEQ ID NO: 33 in WO2012031273 |
| CD46 | VL | 3498 | SEQ ID NO: 37 in WO2012031273 |
| CD46 | VL | 3499 | SEQ ID NO: 45 in WO2012031273 |
| CD46 | VL | 3500 | SEQ ID NO: 49 in WO2012031273 |
| CD46 | VL | 3501 | SEQ ID NO: 53 in WO2012031273 |
| CD46 | VL | 3502 | SEQ ID NO: 57 in WO2012031273 |
| CD46 | VL | 3503 | SEQ ID NO: 65 in WO2012031273 |
| CD46 | VL | 3504 | SEQ ID NO: 69 in WO2012031273 |
| CD46 | VL | 3505 | SEQ ID NO: 73 in WO2012031273 |
| CD46 | VL | 3506 | SEQ ID NO: 77 in WO2012031273 |
| CD46 | VL | 3507 | SEQ ID NO: 81 in WO2012031273 |
| CD46 | VL | 3508 | SEQ ID NO: 85 in WO2012031273 |
| CD46 | VL | 3509 | SEQ ID NO: 17 in WO2012031273 |
| CD46 | VL | 3510 | SEQ ID NO. 23 in WO2016040683 |
| CD46 | VL | 3511 | SEQ ID NO. 24 in WO2016040683 |
| CD46 | VL | 3512 | SEQ ID NO. 25 in WO2016040683 |
| CD46 | VL | 3513 | SEQ ID NO. 26 in WO2016040683 |
| CD46 | VL | 3514 | SEQ ID NO. 27 in WO2016040683 |
| CD46 | VL | 3515 | SEQ ID NO. 28 in WO2016040683 |
| CD46 | VL | 3516 | SEQ ID NO. 29 in WO2016040683 |
| CD46 | VL | 3517 | SEQ ID NO. 30 in WO2016040683 |
| CD46 | VL | 3518 | SEQ ID NO. 31 in WO2016040683 |
| CD46 | VL | 3519 | SEQ ID NO. 32 in WO2016040683 |
| CD46 | VL | 3520 | SEQ ID NO. 33 in WO2016040683 |
| CD46 | VL | 3521 | SEQ ID NO. 34 in WO2016040683 |

TABLE 10-continued

Variable Heavy and Light Chain Sequences

| Target | Antibody chain | SEQ ID NO | Source |
|---|---|---|---|
| CD46 | VL | 3522 | SEQ ID NO. 35 in WO2016040683 |
| CD46 | VL | 3523 | SEQ ID NO. 36 in WO2016040683 |
| CD46 | VL | 3524 | SEQ ID NO. 37 in WO2016040683 |
| CD46 | VL | 3525 | SEQ ID NO. 38 in WO2016040683 |
| CD46 | VL | 3526 | SEQ ID NO. 39 in WO2016040683 |
| CD46 | VL | 3527 | SEQ ID NO. 40 in WO2016040683 |
| CD46 | VL | 3528 | SEQ ID NO. 41 in WO2016040683 |
| CD46 | VL | 3529 | SEQ ID NO. 42 in WO2016040683 |
| CD46 | VL | 3530 | SEQ ID NO: 73 in WO2012031273 |
| CD46 | VL | 3531 | SEQ ID NO: 77 in WO2012031273 |
| CD4BS | VL | 3532 | SEQ ID NO: 14 in US20160194375A1 |
| CD4BS | VL | 3533 | SEQ ID NO: 2 in US20160194375A1 |
| CD4i | VL | 3534 | SEQ ID NO: 4 in US20160194375A1 |
| CD52 | VL | 3535 | SEQ ID NO: 102 in WO2010132659 |
| CD52 | VL | 3536 | SEQ ID NO: 138 in WO2010132659 |
| CD64 | VL | 3537 | SEQ ID NO: 128 in WO2016122701 |
| CD7 | VL | 3538 | SEQ ID NO: 17 in WO2016126213A1 |
| CD7 | VL | 3539 | SEQ ID NO: 21 in WO2016126213A1 |
| CD70 | VL | 3540 | SEQ ID NO. 83 in WO2015121454 |
| CD70 | VL | 3541 | SEQ ID NO. 87 in WO2015121454 |
| CD70 | VL | 3542 | SEQ ID NO. 91 in WO2015121454 |
| CD71 | VL | 3543 | SEQ ID NO. 2 in US20160355599 |
| CD71 | VL | 3544 | SEQ ID NO. 327 in US20160355599 |
| CD71 | VL | 3545 | SEQ ID NO. 329 in US20160355599 |
| CD71 | VL | 3546 | SEQ ID NO. 331 in US20160355599 |
| CD71 | VL | 3547 | SEQ ID NO. 333 in US20160355599 |
| CD71 | VL | 3548 | SEQ ID NO. 335 in US20160355599 |
| CD71 | VL | 3549 | SEQ ID NO. 337 in US20160355599 |
| CD71 | VL | 3550 | SEQ ID NO. 6 in US20160355599 |
| CD71 | VL | 3551 | SEQ ID NO. 650 in US20160355599 |
| CD71 | VL | 3552 | SEQ ID NO. 652 in US20160355599 |
| CD71 | VL | 3553 | SEQ ID NO. 654 in US20160355599 |
| CD71 | VL | 3554 | SEQ ID NO. 656 in US20160355599 |
| CD71 | VL | 3555 | SEQ ID NO. 658 in US20160355599 |
| CD71 | VL | 3556 | SEQ ID NO. 660 in US20160355599 |
| CD71 | VL | 3557 | SEQ ID NO. 670 in US20160355599 |
| CD71 | VL | 3558 | SEQ ID NO. 671 in US20160355599 |
| CD71 | VL | 3559 | SEQ ID NO. 672 in US20160355599 |
| CD71 | VL | 3560 | SEQ ID NO. 673 in US20160355599 |
| CD71 | VL | 3561 | SEQ ID NO. 7 in US20160355599 |
| CD71 | VL | 3562 | SEQ ID NO. 701 in US20160355599 |
| CD71 | VL | 3563 | SEQ ID NO. 702 in US20160355599 |
| CD71 | VL | 3564 | SEQ ID NO. 703 in US20160355599 |
| CD71 | VL | 3565 | SEQ ID NO. 704 in US20160355599 |
| CD71 | VL | 3566 | SEQ ID NO. 705 in US20160355599 |
| CD71 | VL | 3567 | SEQ ID NO. 706 in US20160355599 |
| CD71 | VL | 3568 | SEQ ID NO. 707 in US20160355599 |
| CD71 | VL | 3569 | SEQ ID NO. 708 in US20160355599 |
| CD71 | VL | 3570 | SEQ ID NO. 709 in US20160355599 |
| CD71 | VL | 3571 | SEQ ID NO. 710 in US20160355599 |
| CD71 | VL | 3572 | SEQ ID NO. 711 in US20160355599 |
| CD71 | VL | 3573 | SEQ ID NO. 712 in US20160355599 |
| CD71 | VL | 3574 | SEQ ID NO. 721 in US20160355599 |
| CD71 | VL | 3575 | SEQ ID NO. 722 in US20160355599 |
| CD71 | VL | 3576 | SEQ ID NO. 723 in US20160355599 |
| CD71 | VL | 3577 | SEQ ID NO. 724 in US20160355599 |
| CD71 | VL | 3578 | SEQ ID NO. 725 in US20160355599 |
| CD71 | VL | 3579 | SEQ ID NO. 726 in US20160355599 |
| CD71 | VL | 3580 | SEQ ID NO. 727 in US20160355599 |
| CD71 | VL | 3581 | SEQ ID NO. 728 in US20160355599 |
| CD71 | VL | 3582 | SEQ ID NO. 729 in US20160355599 |
| CD71 | VL | 3583 | SEQ ID NO. 730 in US20160355599 |
| CD71 | VL | 3584 | SEQ ID NO. 731 in US20160355599 |
| CD71 | VL | 3585 | SEQ ID NO. 732 in US20160355599 |
| CD71 | VL | 3586 | SEQ ID NO. 733 in US20160355599 |
| CD71 | VL | 3587 | SEQ ID NO. 734 in US20160355599 |
| CD71 | VL | 3588 | SEQ ID NO. 735 in US20160355599 |
| CD71 | VL | 3589 | SEQ ID NO. 736 in US20160355599 |
| CD71 | VL | 3590 | SEQ ID NO. 737 in US20160355599 |
| CD71 | VL | 3591 | SEQ ID NO. 738 in US20160355599 |
| CD71 | VL | 3592 | SEQ ID NO. 739 in US20160355599 |
| CD71 | VL | 3593 | SEQ ID NO. 740 in US20160355599 |
| CD71 | VL | 3594 | SEQ ID NO. 741 in US20160355599 |
| CD71 | VL | 3595 | SEQ ID NO. 742 in US20160355599 |
| CD71 | VL | 3596 | SEQ ID NO. 743 in US20160355599 |

TABLE 10-continued

| Target | Antibody chain | SEQ ID NO | Source |
|---|---|---|---|
| Variable Heavy and Light Chain Sequences | | | |
| CD71 | VL | 3597 | SEQ ID NO. 744 in US20160355599 |
| CD71 | VL | 3598 | SEQ ID NO. 745 in US20160355599 |
| CD71 | VL | 3599 | SEQ ID NO. 746 in US20160355599 |
| CD71 | VL | 3600 | SEQ ID NO. 747 in US20160355599 |
| CD71 | VL | 3601 | SEQ ID NO. 748 in US20160355599 |
| CD71 | VL | 3602 | SEQ ID NO. 749 in US20160355599 |
| CD71 | VL | 3603 | SEQ ID NO. 750 in US20160355599 |
| CD71 | VL | 3604 | SEQ ID NO. 751 in US20160355599 |
| CD71 | VL | 3605 | SEQ ID NO. 752 in US20160355599 |
| CD71 | VL | 3606 | SEQ ID NO. 753 in US20160355599 |
| CD71 | VL | 3607 | SEQ ID NO. 754 in US20160355599 |
| CD71 | VL | 3608 | SEQ ID NO. 755 in US20160355599 |
| CD71 | VL | 3609 | SEQ ID NO. 756 in US20160355599 |
| CD71 | VL | 3610 | SEQ ID NO. 757 in US20160355599 |
| CD71 | VL | 3611 | SEQ ID NO. 758 in US20160355599 |
| CD71 | VL | 3612 | SEQ ID NO. 759 in US20160355599 |
| CD71 | VL | 3613 | SEQ ID NO. 760 in US20160355599 |
| CD71 | VL | 3614 | SEQ ID NO. 761 in US20160355599 |
| CD71 | VL | 3615 | SEQ ID NO. 762 in US20160355599 |
| CD71 | VL | 3616 | SEQ ID NO. 763 in US20160355599 |
| CD71 | VL | 3617 | SEQ ID NO. 764 in US20160355599 |
| CD71 | VL | 3618 | SEQ ID NO. 765 in US20160355599 |
| CD71 | VL | 3619 | SEQ ID NO. 766 in US20160355599 |
| CD71 | VL | 3620 | SEQ ID NO. 767 in US20160355599 |
| CD71 | VL | 3621 | SEQ ID NO. 768 in US20160355599 |
| CD71 | VL | 3622 | SEQ ID NO. 769 in US20160355599 |
| CD71 | VL | 3623 | SEQ ID NO. 770 in US20160355599 |
| CD71 | VL | 3624 | SEQ ID NO. 771 in US20160355599 |
| CD71 | VL | 3625 | SEQ ID NO. 772 in US20160355599 |
| CD71 | VL | 3626 | SEQ ID NO. 773 in US20160355599 |
| CD71 | VL | 3627 | SEQ ID NO. 774 in US20160355599 |
| CD71 | VL | 3628 | SEQ ID NO. 775 in US20160355599 |
| CD71 | VL | 3629 | SEQ ID NO. 776 in US20160355599 |
| CD71 | VL | 3630 | SEQ ID NO. 777 in US20160355599 |
| CD71 | VL | 3631 | SEQ ID NO. 778 in US20160355599 |
| CD71 | VL | 3632 | SEQ ID NO. 779 in US20160355599 |
| CD71 | VL | 3633 | SEQ ID NO. 780 in US20160355599 |
| CD71 | VL | 3634 | SEQ ID NO. 781 in US20160355599 |
| CD71 | VL | 3635 | SEQ ID NO. 782 in US20160355599 |
| CD71 | VL | 3636 | SEQ ID NO. 783 in US20160355599 |
| CD71 | VL | 3637 | SEQ ID NO. 784 in US20160355599 |
| CD71 | VL | 3638 | SEQ ID NO. 785 in US20160355599 |
| CD71 | VL | 3639 | SEQ ID NO. 786 in US20160355599 |
| CD71 | VL | 3640 | SEQ ID NO. 787 in US20160355599 |
| CD71 | VL | 3641 | SEQ ID NO. 788 in US20160355599 |
| CD71 | VL | 3642 | SEQ ID NO. 8 in US20160355599 |
| CD71 | VL | 3643 | SEQ ID NO. 810 in US20160355599 |
| CD71 | VL | 3644 | SEQ ID NO. 811 in US20160355599 |
| CD71 | VL | 3645 | SEQ ID NO. 812 in US20160355599 |
| CD71 | VL | 3646 | SEQ ID NO. 813 in US20160355599 |
| CD71 | VL | 3647 | SEQ ID NO. 814 in US20160355599 |
| CD71 | VL | 3648 | SEQ ID NO. 815 in US20160355599 |
| CD71 | VL | 3649 | SEQ ID NO. 816 in US20160355599 |
| CD71 | VL | 3650 | SEQ ID NO. 817 in US20160355599 |
| CD71 | VL | 3651 | SEQ ID NO. 818 in US20160355599 |
| CD71 | VL | 3652 | SEQ ID NO. 819 in US20160355599 |
| CD71 | VL | 3653 | SEQ ID NO. 820 in US20160355599 |
| CD71 | VL | 3654 | SEQ ID NO. 821 in US20160355599 |
| CD71 | VL | 3655 | SEQ ID NO. 822 in US20160355599 |
| CD71 | VL | 3656 | SEQ ID NO. 823 in US20160355599 |
| CD71 | VL | 3657 | SEQ ID NO. 824 in US20160355599 |
| CD71 | VL | 3658 | SEQ ID NO. 825 in US20160355599 |
| CD71 | VL | 3659 | SEQ ID NO. 826 in US20160355599 |
| CD71 | VL | 3660 | SEQ ID NO. 827 in US20160355599 |
| CD71 | VL | 3661 | SEQ ID NO. 828 in US20160355599 |
| CD71 | VL | 3662 | SEQ ID NO. 829 in US20160355599 |
| CD71 | VL | 3663 | SEQ ID NO. 830 in US20160355599 |
| CD71 | VL | 3664 | SEQ ID NO. 831 in US20160355599 |
| CD71 | VL | 3665 | SEQ ID NO. 832 in US20160355599 |
| CD71 | VL | 3666 | SEQ ID NO. 833 in US20160355599 |
| CD71 | VL | 3667 | SEQ ID NO. 834 in US20160355599 |
| CD71 | VL | 3668 | SEQ ID NO. 835 in US20160355599 |
| CD71 | VL | 3669 | SEQ ID NO. 836 in US20160355599 |
| CD71 | VL | 3670 | SEQ ID NO. 841 in US20160355599 |
| CD71 | VL | 3671 | SEQ ID NO. 842 in US20160355599 |

TABLE 10-continued

Variable Heavy and Light Chain Sequences

| Target | Antibody chain | SEQ ID NO | Source |
|---|---|---|---|
| CD71 | VL | 3672 | SEQ ID NO. 843 in US20160355599 |
| CD71 | VL | 3673 | SEQ ID NO. 844 in US20160355599 |
| CD71 | VL | 3674 | SEQ ID NO. 845 in US20160355599 |
| CD71 | VL | 3675 | SEQ ID NO. 846 in US20160355599 |
| CD71 | VL | 3676 | SEQ ID NO. 847 in US20160355599 |
| CD71 | VL | 3677 | SEQ ID NO. 848 in US20160355599 |
| CD71 | VL | 3678 | SEQ ID NO. 849 in US20160355599 |
| CD71 | VL | 3679 | SEQ ID NO. 850 in US20160355599 |
| CD71 | VL | 3680 | SEQ ID NO. 851 in US20160355599 |
| CD71 | VL | 3681 | SEQ ID NO. 852 in US20160355599 |
| CD71 | VL | 3682 | SEQ ID NO. 853 in US20160355599 |
| CD71 | VL | 3683 | SEQ ID NO. 854 in US20160355599 |
| CD71 | VL | 3684 | SEQ ID NO. 855 in US20160355599 |
| CD71 | VL | 3685 | SEQ ID NO. 856 in US20160355599 |
| CD71 | VL | 3686 | SEQ ID NO. 857 in US20160355599 |
| CD71 | VL | 3687 | SEQ ID NO. 858 in US20160355599 |
| CD71 | VL | 3688 | SEQ ID NO. 859 in US20160355599 |
| CD71 | VL | 3689 | SEQ ID NO. 860 in US20160355599 |
| CD71 | VL | 3690 | SEQ ID NO. 861 in US20160355599 |
| CD71 | VL | 3691 | SEQ ID NO. 862 in US20160355599 |
| CD71 | VL | 3692 | SEQ ID NO. 863 in US20160355599 |
| CD71 | VL | 3693 | SEQ ID NO. 864 in US20160355599 |
| CD71 | VL | 3694 | SEQ ID NO. 865 in US20160355599 |
| CD71 | VL | 3695 | SEQ ID NO. 866 in US20160355599 |
| CD71 | VL | 3696 | SEQ ID NO. 867 in US20160355599 |
| CD71 | VL | 3697 | SEQ ID NO. 868 in US20160355599 |
| CD71 | VL | 3698 | SEQ ID NO. 869 in US20160355599 |
| CD71 | VL | 3699 | SEQ ID NO. 870 in US20160355599 |
| CD71 | VL | 3700 | SEQ ID NO. 871 in US20160355599 |
| CD71 | VL | 3701 | SEQ ID NO. 872 in US20160355599 |
| CD71 | VL | 3702 | SEQ ID NO. 873 in US20160355599 |
| CD71 | VL | 3703 | SEQ ID NO. 874 in US20160355599 |
| CD71 | VL | 3704 | SEQ ID NO. 875 in US20160355599 |
| CD71 | VL | 3705 | SEQ ID NO. 876 in US20160355599 |
| CD71 | VL | 3706 | SEQ ID NO. 877 in US20160355599 |
| CD71 | VL | 3707 | SEQ ID NO. 878 in US20160355599 |
| CD71 | VL | 3708 | SEQ ID NO. 879 in US20160355599 |
| CD71 | VL | 3709 | SEQ ID NO. 880 in US20160355599 |
| CD71 | VL | 3710 | SEQ ID NO. 881 in US20160355599 |
| CD71 | VL | 3711 | SEQ ID NO. 882 in US20160355599 |
| CD71 | VL | 3712 | SEQ ID NO. 883 in US20160355599 |
| CD71 | VL | 3713 | SEQ ID NO. 884 in US20160355599 |
| CD71 | VL | 3714 | SEQ ID NO. 885 in US20160355599 |
| CD71 | VL | 3715 | SEQ ID NO. 886 in US20160355599 |
| CD71 | VL | 3716 | SEQ ID NO. 887 in US20160355599 |
| CD71 | VL | 3717 | SEQ ID NO. 888 in US20160355599 |
| CD71 | VL | 3718 | SEQ ID NO. 889 in US20160355599 |
| CD71 | VL | 3719 | SEQ ID NO. 890 in US20160355599 |
| CD71 | VL | 3720 | SEQ ID NO. 891 in US20160355599 |
| CD71 | VL | 3721 | SEQ ID NO. 892 in US20160355599 |
| CD71 | VL | 3722 | SEQ ID NO. 893 in US20160355599 |
| CD71 | VL | 3723 | SEQ ID NO. 894 in US20160355599 |
| CD71 | VL | 3724 | SEQ ID NO. 895 in US20160355599 |
| CD71 | VL | 3725 | SEQ ID NO. 896 in US20160355599 |
| CD71 | VL | 3726 | SEQ ID NO. 897 in US20160355599 |
| CD71 | VL | 3727 | SEQ ID NO. 898 in US20160355599 |
| CD71 | VL | 3728 | SEQ ID NO. 899 in US20160355599 |
| CD71 | VL | 3729 | SEQ ID NO. 900 in US20160355599 |
| CD71 | VL | 3730 | SEQ ID NO. 901 in US20160355599 |
| CD71 | VL | 3731 | SEQ ID NO. 902 in US20160355599 |
| CD71 | VL | 3732 | SEQ ID NO. 903 in US20160355599 |
| CD71 | VL | 3733 | SEQ ID NO. 904 in US20160355599 |
| CD71 | VL | 3734 | SEQ ID NO. 905 in US20160355599 |
| CD71 | VL | 3735 | SEQ ID NO. 906 in US20160355599 |
| CD71 | VL | 3736 | SEQ ID NO. 907 in US20160355599 |
| CD71 | VL | 3737 | SEQ ID NO. 908 in US20160355599 |
| CD73 | VL | 3738 | SEQ ID NO. 12 in US20160145350 |
| CD73 | VL | 3739 | SEQ ID NO. 20 in US20160145350 |
| CD73 | VL | 3740 | SEQ ID NO. 44 in US20160145350 |
| CD73 | VL | 3741 | SEQ ID NO. 72 in US20160145350 |
| CD73 | VL | 3742 | SEQ ID NO. 76 in US20160145350 |
| CD73 | VL | 3743 | SEQ ID NO. 8 in US20160145350 |
| CD73 | VL | 3744 | SEQ ID NO. 84 in US20160145350 |
| CD73 | VL | 3745 | SEQ ID NO. 92 in US20160145350 |
| CD73 | VL | 3746 | SEQ ID NO. 22 in WO2016055609A1 |

TABLE 10-continued

Variable Heavy and Light Chain Sequences

| Target | Antibody chain | SEQ ID NO | Source |
|---|---|---|---|
| CD73 | VL | 3747 | SEQ ID NO. 29 in WO2016055609A1 |
| CD73 | VL | 3748 | SEQ ID NO. 37 in WO2016055609A1 |
| CD73 | VL | 3749 | SEQ ID NO. 4 in WO2016055609A1 |
| CD74 | VL | 3750 | FIG. 1B in WO2003074567 |
| CD74 | VL | 3751 | FIG. 2B in WO2003074567 |
| CD74 | VL | 3752 | FIG. 4B in WO2003074567 |
| CD74 | VL | 3753 | SEQ ID NO 12 in US20040115193A1 |
| CD74 | VL | 3754 | SEQ ID NO 13 in US20040115193A1 |
| CD74 | VL | 3755 | SEQ ID NO 14 in US20040115193A1 |
| CD74 | VL | 3756 | SEQ ID NO. 11 in US20100284906A1 |
| CD74 | VL | 3757 | SEQ ID NO. 4 in US20100284906A1 |
| CD76b | VL | 3758 | SEQ ID NO. 16 in US20160159906 |
| CD76b | VL | 3759 | SEQ ID NO. 18 in US20160159906 |
| CD76b | VL | 3760 | SEQ ID NO. 22 in US20160159906 |
| CD76b | VL | 3761 | SEQ ID NO. 38 in US20160159906 |
| CD76b | VL | 3762 | SEQ ID NO. 58 in US20160159906 |
| CD76b | VL | 3763 | SEQ ID NO. 60 in US20160159906 |
| CD76b | VL | 3764 | SEQ ID NO. 62 in US20160159906 |
| CD79 | VL | 3765 | SEQ ID NO. 130 in WO2016122701 |
| CDIM | VL | 3766 | SEQ ID NO. 28 in WO2013120012 |
| CDIM | VL | 3767 | SEQ ID NO. 29 in WO2013120012 |
| CDIM | VL | 3768 | SEQ ID NO. 30 in WO2013120012 |
| CDIM | VL | 3769 | SEQ ID NO. 31 in WO2013120012 |
| CDIM | VL | 3770 | SEQ ID NO. 32 in WO2013120012 |
| CDIM | VL | 3771 | SEQ ID NO. 33 in WO2013120012 |
| CDIM | VL | 3772 | SEQ ID NO. 34 in WO2013120012 |
| CDIM | VL | 3773 | SEQ ID NO. 35 in WO2013120012 |
| CDIM | VL | 3774 | SEQ ID NO. 36 in WO2013120012 |
| CDIM | VL | 3775 | SEQ ID NO. 37 in WO2013120012 |
| CDIM | VL | 3776 | SEQ ID NO. 38 in WO2013120012 |
| CDIM | VL | 3777 | SEQ ID NO. 39 in WO2013120012 |
| CDIM | VL | 3778 | SEQ ID NO. 40 in WO2013120012 |
| CDIM | VL | 3779 | SEQ ID NO. 41 in WO2013120012 |
| CDIM | VL | 3780 | SEQ ID NO. 42 in WO2013120012 |
| CDIM | VL | 3781 | SEQ ID NO. 43 in WO2013120012 |
| CDIM | VL | 3782 | SEQ ID NO. 44 in WO2013120012 |
| CDIM | VL | 3783 | SEQ ID NO. 45 in WO2013120012 |
| CDIM | VL | 3784 | SEQ ID NO. 46 in WO2013120012 |
| CDIM | VL | 3785 | SEQ ID NO. 47 in WO2013120012 |
| CDIM | VL | 3786 | SEQ ID NO. 48 in WO2013120012 |
| CDIM | VL | 3787 | SEQ ID NO. 49 in WO2013120012 |
| CEA | VL | 3788 | SEQ ID NO: 10 in U.S. Pat. No. 8,287,865 |
| CEA | VL | 3789 | SEQ ID NO: 38 in U.S. Pat. No. 8,287,865 |
| CEA | VL | 3790 | SEQ ID NO: 39 in U.S. Pat. No. 8,287,865 |
| CEA | VL | 3791 | SEQ ID NO: 7 in U.S. Pat. No. 8,287,865 |
| CEA | VL | 3792 | SEQ ID NO: 9 in U.S. Pat. No. 8,287,865 |
| Claudin | VL | 3793 | SEQ ID NO. 114 in WO2016073649A1 |
| Claudin | VL | 3794 | SEQ ID NO. 116 in WO2016073649A1 |
| Claudin | VL | 3795 | SEQ ID NO. 118 in WO2016073649A1 |
| Claudin | VL | 3796 | SEQ ID NO. 120 in WO2016073649A1 |
| Claudin | VL | 3797 | SEQ ID NO. 22 in WO2016073649A1 |
| Claudin | VL | 3798 | SEQ ID NO. 25 in WO2016073649A1 |
| Claudin | VL | 3799 | SEQ ID NO. 29 in WO2016073649A1 |
| Claudin | VL | 3800 | SEQ ID NO. 33 in WO2016073649A1 |
| Claudin | VL | 3801 | SEQ ID NO. 37 in WO2016073649A1 |
| Claudin | VL | 3802 | SEQ ID NO. 41 in WO2016073649A1 |
| Claudin | VL | 3803 | SEQ ID NO. 45 in WO2016073649A1 |
| Claudin | VL | 3804 | SEQ ID NO. 49 in WO2016073649A1 |
| Claudin | VL | 3805 | SEQ ID NO. 53 in WO2016073649A1 |
| Claudin | VL | 3806 | SEQ ID NO. 57 in WO2016073649A1 |
| Claudin | VL | 3807 | SEQ ID NO. 61 in WO2016073649A1 |
| Claudin | VL | 3808 | SEQ ID NO. 65 in WO2016073649A1 |
| Claudin | VL | 3809 | SEQ ID NO. 69 in WO2016073649A1 |
| Claudin | VL | 3810 | SEQ ID NO. 73 in WO2016073649A1 |
| Claudin | VL | 3811 | SEQ ID NO. 77 in WO2016073649A1 |
| CLDN18.2 | VL | 3812 | SEQ ID No. 13 in US20160347815A1 |
| CLDN18.2 | VL | 3813 | SEQ ID No. 3 in US20160347815A1 |
| CLL1 | VL | 3814 | SEQ ID NO. 16 in WO2016120219 |
| CLL1 | VL | 3815 | SEQ ID NO. 18 in WO2016120219 |
| CLL1 | VL | 3816 | SEQ ID NO. 196 in WO2016014535 |
| CLL1 | VL | 3817 | SEQ ID NO. 20 in WO2016120219 |
| CLL1 | VL | 3818 | SEQ ID NO. 22 in WO2016120219 |
| CLL1 | VL | 3819 | SEQ ID NO. 24 in WO2016120219 |
| CLL1 | VL | 3820 | SEQ ID NO. 26 in WO2016120219 |
| CLL1 | VL | 3821 | SEQ ID NO. 28 in WO2016120219 |

TABLE 10-continued

Variable Heavy and Light Chain Sequences

| Target | Antibody chain | SEQ ID NO | Source |
|---|---|---|---|
| CLL1 | VL | 3822 | SEQ ID NO. 30 in WO2016120219 |
| CLL1 | VL | 3823 | SEQ ID NO. 32 in WO2016120219 |
| CLL1 | VL | 3824 | SEQ ID NO. 34 in WO2016120219 |
| CLL1 | VL | 3825 | SEQ ID NO. 36 in WO2016120219 |
| CLL1 | VL | 3826 | SEQ ID NO. 78 in WO2016014535 |
| CLL1 | VL | 3827 | SEQ ID NO. 79 in WO2016014535 |
| CLL1 | VL | 3828 | SEQ ID NO. 80 in WO2016014535 |
| CLL1 | VL | 3829 | SEQ ID NO. 81 in WO2016014535 |
| CLL1 | VL | 3830 | SEQ ID NO. 82 in WO2016014535 |
| CLL1 | VL | 3831 | SEQ ID NO. 83 in WO2016014535 |
| CLL1 | VL | 3832 | SEQ ID NO. 84 in WO2016014535 |
| CLL1 | VL | 3833 | SEQ ID NO. 85 in WO2016014535 |
| CLL1 | VL | 3834 | SEQ ID NO. 86 in WO2016014535 |
| CLL1 | VL | 3835 | SEQ ID NO. 87 in WO2016014535 |
| CLL1 | VL | 3836 | SEQ ID NO. 88 in WO2016014535 |
| CLL1 | VL | 3837 | SEQ ID NO. 89 in WO2016014535 |
| CLL1 | VL | 3838 | SEQ ID NO. 90 in WO2016014535 |
| CLL1 | VL | 3839 | SEQ ID NO. 30 in US20160075787 |
| CLL1 | VL | 3840 | SEQ ID NO. 32 in US20160075787 |
| CLL1 | VL | 3841 | SEQ ID NO. 35 in US20160075787 |
| CLL1 | VL | 3842 | SEQ ID NO. 37 in US20160075787 |
| CLL1 | VL | 3843 | SEQ ID NO. 39 in US20160075787 |
| CLL1 | VL | 3844 | SEQ ID NO. 41 in US20160075787 |
| CLL1 | VL | 3845 | SEQ ID NO: 152 in WO2016179319A1 |
| CLL1 | VL | 3846 | SEQ ID NO: 104 in WO2016179319A1 |
| CLL1 | VL | 3847 | SEQ ID NO: 106 in WO2016179319A1 |
| CLL1 | VL | 3848 | SEQ ID NO: 108 in WO2016179319A1 |
| CLL1 | VL | 3849 | SEQ ID NO: 110 in WO2016179319A1 |
| CLL1 | VL | 3850 | SEQ ID NO: 112 in WO2016179319A1 |
| CLL1 | VL | 3851 | SEQ ID NO: 114 in WO2016179319A1 |
| CLL1 | VL | 3852 | SEQ ID NO: 116 in WO2016179319A1 |
| CLL1 | VL | 3853 | SEQ ID NO: 118 in WO2016179319A1 |
| CLL3 | VL | 3854 | SEQ ID NO. 100 in US20170000901 |
| CLL3 | VL | 3855 | SEQ ID NO. 102 in US20170000901 |
| CLL3 | VL | 3856 | SEQ ID NO. 104 in US20170000901 |
| CLL3 | VL | 3857 | SEQ ID NO. 106 in US20170000901 |
| CLL3 | VL | 3858 | SEQ ID NO. 108 in US20170000901 |
| CLL3 | VL | 3859 | SEQ ID NO. 110 in US20170000901 |
| CLL3 | VL | 3860 | SEQ ID NO. 112 in US20170000901 |
| CLL3 | VL | 3861 | SEQ ID NO. 114 in US20170000901 |
| CLL3 | VL | 3862 | SEQ ID NO. 116 in US20170000901 |
| CLL3 | VL | 3863 | SEQ ID NO. 118 in US20170000901 |
| CLL3 | VL | 3864 | SEQ ID NO. 120 in US20170000901 |
| CLL3 | VL | 3865 | SEQ ID NO. 122 in US20170000901 |
| CLL3 | VL | 3866 | SEQ ID NO. 124 in US20170000901 |
| CLL3 | VL | 3867 | SEQ ID NO. 126 in US20170000901 |
| CLL3 | VL | 3868 | SEQ ID NO. 128 in US20170000901 |
| CLL3 | VL | 3869 | SEQ ID NO. 130 in US20170000901 |
| CLL3 | VL | 3870 | SEQ ID NO. 132 in US20170000901 |
| CLL3 | VL | 3871 | SEQ ID NO. 134 in US20170000901 |
| CLL3 | VL | 3872 | SEQ ID NO. 136 in US20170000901 |
| CLL3 | VL | 3873 | SEQ ID NO. 138 in US20170000901 |
| CLL3 | VL | 3874 | SEQ ID NO. 140 in US20170000901 |
| CLL3 | VL | 3875 | SEQ ID NO. 144 in US20170000901 |
| CLL3 | VL | 3876 | SEQ ID NO. 146 in US20170000901 |
| CLL3 | VL | 3877 | SEQ ID NO. 148 in US20170000901 |
| CLL3 | VL | 3878 | SEQ ID NO. 150 in US20170000901 |
| CLL3 | VL | 3879 | SEQ ID NO. 152 in US20170000901 |
| CLL3 | VL | 3880 | SEQ ID NO. 154 in US20170000901 |
| CLL3 | VL | 3881 | SEQ ID NO. 156 in US20170000901 |
| CLL3 | VL | 3882 | SEQ ID NO. 158 in US20170000901 |
| CLL3 | VL | 3883 | SEQ ID NO. 160 in US20170000901 |
| CLL3 | VL | 3884 | SEQ ID NO. 162 in US20170000901 |
| CLL3 | VL | 3885 | SEQ ID NO. 164 in US20170000901 |
| CLL3 | VL | 3886 | SEQ ID NO. 166 in US20170000901 |
| CLL3 | VL | 3887 | SEQ ID NO. 170 in US20170000901 |
| CLL3 | VL | 3888 | SEQ ID NO. 172 in US20170000901 |
| CLL3 | VL | 3889 | SEQ ID NO. 174 in US20170000901 |
| CLL3 | VL | 3890 | SEQ ID NO. 176 in US20170000901 |
| CLL3 | VL | 3891 | SEQ ID NO. 178 in US20170000901 |
| CLL3 | VL | 3892 | SEQ ID NO. 180 in US20170000901 |
| CLL3 | VL | 3893 | SEQ ID NO. 182 in US20170000901 |
| CLL3 | VL | 3894 | SEQ ID NO. 184 in US20170000901 |
| CLL3 | VL | 3895 | SEQ ID NO. 186 in US20170000901 |
| CLL3 | VL | 3896 | SEQ ID NO. 190 in US20170000901 |

TABLE 10-continued

Variable Heavy and Light Chain Sequences

| Target | Antibody chain | SEQ ID NO | Source |
|---|---|---|---|
| CLL3 | VL | 3897 | SEQ ID NO. 192 in US20170000901 |
| CLL3 | VL | 3898 | SEQ ID NO. 194 in US20170000901 |
| CLL3 | VL | 3899 | SEQ ID NO. 196 in US20170000901 |
| CLL3 | VL | 3900 | SEQ ID NO. 198 in US20170000901 |
| CLL3 | VL | 3901 | SEQ ID NO. 20 in US20170000901 |
| CLL3 | VL | 3902 | SEQ ID NO. 200 in US20170000901 |
| CLL3 | VL | 3903 | SEQ ID NO. 202 in US20170000901 |
| CLL3 | VL | 3904 | SEQ ID NO. 204 in US20170000901 |
| CLL3 | VL | 3905 | SEQ ID NO. 206 in US20170000901 |
| CLL3 | VL | 3906 | SEQ ID NO. 208 in US20170000901 |
| CLL3 | VL | 3907 | SEQ ID NO. 210 in US20170000901 |
| CLL3 | VL | 3908 | SEQ ID NO. 212 in US20170000901 |
| CLL3 | VL | 3909 | SEQ ID NO. 22 in US20170000901 |
| CLL3 | VL | 3910 | SEQ ID NO. 24 in US20170000901 |
| CLL3 | VL | 3911 | SEQ ID NO. 26 in US20170000901 |
| CLL3 | VL | 3912 | SEQ ID NO. 28 in US20170000901 |
| CLL3 | VL | 3913 | SEQ ID NO. 30 in US20170000901 |
| CLL3 | VL | 3914 | SEQ ID NO. 32 in US20170000901 |
| CLL3 | VL | 3915 | SEQ ID NO. 34 in US20170000901 |
| CLL3 | VL | 3916 | SEQ ID NO. 36 in US20170000901 |
| CLL3 | VL | 3917 | SEQ ID NO. 38 in US20170000901 |
| CLL3 | VL | 3918 | SEQ ID NO. 40 in US20170000901 |
| CLL3 | VL | 3919 | SEQ ID NO. 42 in US20170000901 |
| CLL3 | VL | 3920 | SEQ ID NO. 44 in US20170000901 |
| CLL3 | VL | 3921 | SEQ ID NO. 46 in US20170000901 |
| CLL3 | VL | 3922 | SEQ ID NO. 48 in US20170000901 |
| CLL3 | VL | 3923 | SEQ ID NO. 50 in US20170000901 |
| CLL3 | VL | 3924 | SEQ ID NO. 54 in US20170000901 |
| CLL3 | VL | 3925 | SEQ ID NO. 56 in US20170000901 |
| CLL3 | VL | 3926 | SEQ ID NO. 58 in US20170000901 |
| CLL3 | VL | 3927 | SEQ ID NO. 60 in US20170000901 |
| CLL3 | VL | 3928 | SEQ ID NO. 62 in US20170000901 |
| CLL3 | VL | 3929 | SEQ ID NO. 64 in US20170000901 |
| CLL3 | VL | 3930 | SEQ ID NO. 66 in US20170000901 |
| CLL3 | VL | 3931 | SEQ ID NO. 68 in US20170000901 |
| CLL3 | VL | 3932 | SEQ ID NO. 70 in US20170000901 |
| CLL3 | VL | 3933 | SEQ ID NO. 72 in US20170000901 |
| CLL3 | VL | 3934 | SEQ ID NO. 74 in US20170000901 |
| CLL3 | VL | 3935 | SEQ ID NO. 76 in US20170000901 |
| CLL3 | VL | 3936 | SEQ ID NO. 78 in US20170000901 |
| CLL3 | VL | 3937 | SEQ ID NO. 80 in US20170000901 |
| CLL3 | VL | 3938 | SEQ ID NO. 82 in US20170000901 |
| CLL3 | VL | 3939 | SEQ ID NO. 84 in US20170000901 |
| CLL3 | VL | 3940 | SEQ ID NO. 86 in US20170000901 |
| CLL3 | VL | 3941 | SEQ ID NO. 88 in US20170000901 |
| CLL3 | VL | 3942 | SEQ ID NO. 90 in US20170000901 |
| CLL3 | VL | 3943 | SEQ ID NO. 92 in US20170000901 |
| CLL3 | VL | 3944 | SEQ ID NO. 94 in US20170000901 |
| CLL3 | VL | 3945 | SEQ ID NO. 96 in US20170000901 |
| CLL3 | VL | 3946 | SEQ ID NO. 98 in US20170000901 |
| collagen | VL | 3947 | SEQ ID NO. 11 in WO2007024921 |
| collagen | VL | 3948 | SEQ ID NO. 12 in WO2007024921 |
| collagen | VL | 3949 | SEQ ID NO. 14 in WO2007024921 |
| collagen | VL | 3950 | SEQ ID NO. 23 in WO2007024921 |
| collagen | VL | 3951 | SEQ ID NO. 25 in WO2007024921 |
| collagen | VL | 3952 | SEQ ID NO. 26 in WO2007024921 |
| collagen | VL | 3953 | SEQ ID NO. 27 in WO2007024921 |
| collagen | VL | 3954 | SEQ ID NO. 8 in WO2007024921 |
| collagen | VL | 3955 | SEQ ID NO. 9 in WO2007024921 |
| CS1 | VL | 3956 | SEQ ID NO. 104 in WO2016120216 |
| CS1 | VL | 3957 | SEQ ID NO. 106 in WO2016120216 |
| CS1 | VL | 3958 | SEQ ID NO. 108 in WO2016120216 |
| CS1 | VL | 3959 | SEQ ID NO. 14 in WO2015166056A1 |
| CS1 | VL | 3960 | SEQ ID NO. 16 in WO2015166056A1 |
| CS1 | VL | 3961 | SEQ ID NO. 18 in WO2015166056A1 |
| CS1 | VL | 3962 | SEQ ID NO. 20 in WO2015166056A1 |
| CS1 | VL | 3963 | SEQ ID NO. 22 in WO2015166056A1 |
| CS1 | VL | 3964 | SEQ ID No. 39 in WO2015121454 |
| CS1 | VL | 3965 | SEQ ID No. 41 in WO2015121454 |
| CS1 | VL | 3966 | SEQ ID No. 43 in WO2015121454 |
| CS1 | VL | 3967 | SEQ ID No. 45 in WO2015121454 |
| CS1 | VL | 3968 | SEQ ID No. 47 in WO2015121454 |
| CSF | VL | 3969 | SEQ ID NO 12 in US20050059113A1 |
| CSF | VL | 3970 | SEQ ID NO 32 in US20050059113A1 |
| CSF | VL | 3971 | SEQ ID NO 44 in US20050059113A1 |

TABLE 10-continued

Variable Heavy and Light Chain Sequences

| Target | Antibody chain | SEQ ID NO | Source |
|---|---|---|---|
| CSF | VL | 3972 | SEQ ID NO 48 in US20050059113A1 |
| CSF | VL | 3973 | SEQ ID NO 60 in US20050059113A1 |
| CSPG4 | VL | 3974 | SEQ ID NO. 7 in WO2016164429 |
| CTLA4 | VL | 3975 | SEQ ID NO. 36 in US20140105914 |
| CTLA4 | VL | 3976 | SEQ ID NO. 37 in US20140105914 |
| CTLA4 | VL | 3977 | SEQ ID NO. 38 in US20140105914 |
| CTLA4 | VL | 3978 | SEQ ID NO. 39 in US20140105914 |
| CTLA4 | VL | 3979 | SEQ ID NO. 40 in US20140105914 |
| CTLA4 | VL | 3980 | SEQ ID NO. 46 in US20140105914 |
| CTLA4 | VL | 3981 | SEQ ID NO. 47 in US20140105914 |
| CTLA4 | VL | 3982 | SEQ ID NO. 48 in US20140105914 |
| CTLA4 | VL | 3983 | SEQ ID NO. 49 in US20140105914 |
| CTLA4 | VL | 3984 | SEQ ID NO. 50 in US20140105914 |
| CTLA4 | VL | 3985 | SEQ ID NO. 8 in US20140105914 |
| CTLA4 | VL | 3986 | SEQ ID NO. 2 in U.S. Pat. No. 8,697,845 |
| CTLA4 | VL | 3987 | SEQ ID NO. 4 in US20140105914 |
| CTLA4(Ipilimumab) | VL | 3988 | SEQ ID NO. 20 in US20150283234 |
| CTLA4(Ipilimumab) | VL | 3989 | SEQ ID NO. 18 in WO2014066532 |
| CXCR4 | VL | 3990 | US20110020218 SEQ ID NO: 76 |
| CXCR4 | VL | 3991 | US20110020218 SEQ ID NO: 77 |
| CXCR4 | VL | 3992 | US20110020218 SEQ ID NO: 78 |
| CXCR4 | VL | 3993 | US20110020218 SEQ ID NO: 79 |
| CXCR4 | VL | 3994 | US20110020218 SEQ ID NO: 80 |
| CXCR4 | VL | 3995 | US20110020218 SEQ ID NO: 81 |
| CXCR4 | VL | 3996 | US20110020218 SEQ ID NO: 82 |
| CXCR4 | VL | 3997 | US20110020218 SEQ ID NO: 87 |
| CXCR4 | VL | 3998 | US20110020218 SEQ ID NO: 88 |
| CXCR4 | VL | 3999 | US20110020218 SEQ ID NO: 90 |
| CXCR4 | VL | 4000 | US20110020218 SEQ ID NO: 91 |
| CXCR4 | VL | 4001 | US20110020218 SEQ ID NO: 92 |
| CXCR4 | VL | 4002 | US20110020218 SEQ ID NO: 93 |
| Daclizumab | VL | 4003 | SEQ ID NO: 43 in US20160333114A1 |
| Daclizumab | VL | 4004 | SEQ ID NO: 45 in US20160333114A1 |
| DR5 | VL | 4005 | SEQ ID NO. 13 in WO2016122701 |
| DR5 | VL | 4006 | SEQ ID NO. 23 in WO2016122701 |
| DR5 | VL | 4007 | SEQ ID NO. 25 in WO2016122701 |
| DR5 | VL | 4008 | SEQ ID NO. 27 in WO2016122701 |
| DR5 | VL | 4009 | SEQ ID NO. 3 in WO2016122701 |
| DR5 | VL | 4010 | SEQ ID NO. 78 in WO2016122701 |
| DR5 | VL | 4011 | SEQ ID NO. 86 in WO2016122701 |
| DR5 | VL | 4012 | SEQ ID NO. 94 in WO2016122701 |
| DR5 | VL | 4013 | SEQ ID NO. 29 in WO2016122701 |
| DR5(Conatumumab) | VL | 4014 | SEQ ID NO. 62 in WO2016122701 |
| DR5(Drozitumab) | VL | 4015 | SEQ ID NO. 54 in WO2016122701 |
| DR5(Tigatumumab) | VL | 4016 | SEQ ID NO. 70 in WO2016122701 |
| E7MC | VL | 4017 | SEQ ID NO: 238 in WO2016182957A1 |
| E7MC | VL | 4018 | SEQ ID NO: 239 in WO2016182957A1 |
| E7MC | VL | 4019 | SEQ ID NO: 240 in WO2016182957A1 |
| E7MC | VL | 4020 | SEQ ID NO: 241 in WO2016182957A1 |
| E7MC | VL | 4021 | SEQ ID NO: 242 in WO2016182957A1 |
| E7MC | VL | 4022 | SEQ ID NO: 243 in WO2016182957A1 |
| E7MC | VL | 4023 | SEQ ID NO: 36 in WO2016182957A1 |
| E7MC | VL | 4024 | SEQ ID NO: 37 in WO2016182957A1 |
| E7MC | VL | 4025 | SEQ ID NO: 38 in WO2016182957A1 |
| E7MC | VL | 4026 | SEQ ID NO: 39 in WO2016182957A1 |
| E7MC | VL | 4027 | SEQ ID NO: 41 in WO2016182957A1 |
| E7MC | VL | 4028 | SEQ ID NO: 42 in WO2016182957A1 |
| E7MC | VL | 4029 | SEQ ID NO: 43 in WO2016182957A1 |
| E7MC | VL | 4030 | SEQ ID NO: 44 in WO2016182957A1 |
| E7MC | VL | 4031 | SEQ ID NO: 45 in WO2016182957A1 |
| E7MC | VL | 4032 | SEQ ID NO: 46 in WO2016182957A1 |
| E7MC | VL | 4033 | SEQ ID NO: 47 in WO2016182957A1 |
| E7MC | VL | 4034 | SEQ ID NO: 48 in WO2016182957A1 |
| E7MC | VL | 4035 | SEQ ID NO: 49 in WO2016182957A1 |
| E7MC | VL | 4036 | SEQ ID NO: 50 in WO2016182957A1 |
| E7MC | VL | 4037 | SEQ ID NO: 51 in WO2016182957A1 |
| E7MC | VL | 4038 | SEQ ID NO: 52 in WO2016182957A1 |
| E7MC | VL | 4039 | SEQ ID NO: 53 in WO2016182957A1 |
| E7MC | VL | 4040 | SEQ ID NO: 54 in WO2016182957A1 |
| E7MC | VL | 4041 | SEQ ID NO: 55 in WO2016182957A1 |
| E7MC | VL | 4042 | SEQ ID NO: 56 in WO2016182957A1 |
| EFNA | VL | 4043 | SEQ ID NO: 151 in WO2012118547 |
| EFNA | VL | 4044 | SEQ ID NO: 155 in WO2012118547 |
| EFNA | VL | 4045 | SEQ ID NO: 159 in WO2012118547 |
| EFNA | VL | 4046 | SEQ ID NO: 163 in WO2012118547 |

TABLE 10-continued

Variable Heavy and Light Chain Sequences

| Target | Antibody chain | SEQ ID NO | Source |
|---|---|---|---|
| EFNA4 | VL | 4047 | SEQ ID NO. 27 in US20150125472 |
| EFNA4 | VL | 4048 | SEQ ID NO. 53 in US20150125472 |
| EGFR | VL | 4049 | SEQ ID NO. 15 in WO2015143382 |
| EGFR | VL | 4050 | SEQ ID NO. 14 in WO2014143765 |
| EGFR | VL | 4051 | |
| EGFR | VL | 4052 | |
| EGFR | VL | 4053 | |
| EGFR | VL | 4054 | |
| EGFR | VL | 4055 | |
| EGFR | VL | 4056 | |
| EGFR | VL | 4057 | |
| EGFR | VL | 4058 | |
| EGFR | VL | 4059 | |
| EGFR | VL | 4060 | |
| EGFR | VL | 4061 | |
| EGFR | VL | 4062 | |
| EGFR | VL | 4063 | |
| EGFR | VL | 4064 | |
| EGFR | VL | 4065 | |
| EGFR | VL | 4066 | |
| EGFR | VL | 4067 | |
| EGFR | VL | 4068 | |
| EGFR | VL | 4069 | |
| EGFR | VL | 4070 | |
| EGFR | VL | 4071 | |
| EGFR | VL | 4072 | |
| EGFR | VL | 4073 | |
| EGFR | VL | 4074 | |
| EGFR | VL | 4075 | |
| EGFR | VL | 4076 | |
| EGFR | VL | 4077 | |
| EGFR | VL | 4078 | |
| EGFR | VL | 4079 | |
| EGFR | VL | 4080 | |
| EGFR | VL | 4081 | |
| EGFR | VL | 4082 | |
| EGFR | VL | 4083 | |
| EGFR | VL | 4084 | |
| EGFR | VL | 4085 | |
| EGFR | VL | 4086 | |
| EGFR | VL | 4087 | |
| EGFR | VL | 4088 | |
| EGFR | VL | 4089 | |
| EGFR | VL | 4090 | |
| EGFR | VL | 4091 | |
| EGFR | VL | 4092 | |
| EGFR | VL | 4093 | |
| EGFR | VL | 4094 | |
| EGFR | VL | 4095 | |
| EGFR | VL | 4096 | |
| EGFR | VL | 4097 | |
| EGFR | VL | 4098 | |
| EGFR | VL | 4099 | |
| EGFR | VL | 4100 | |
| EGFR | VL | 4101 | |
| EGFR | VL | 4102 | |
| EGFR | VL | 4103 | |
| EGFR | VL | 4104 | |
| EGFR | VL | 4105 | |
| EGFR | VL | 4106 | |
| EGFR | VL | 4107 | |
| EGFR | VL | 4108 | |
| EGFR | VL | 4109 | |
| EGFR | VL | 4110 | |
| EGFR | VL | 4111 | |
| EGFR | VL | 4112 | |
| EGFR | VL | 4113 | |
| EGFR | VL | 4114 | |
| EGFR | VL | 4115 | |
| EGFR | VL | 4116 | |
| EGFR | VL | 4117 | |
| EGFR | VL | 4118 | |
| EGFR | VL | 4119 | |
| EGFR | VL | 4120 | |
| EGFR | VL | 4121 | |

TABLE 10-continued

Variable Heavy and Light Chain Sequences

| Target | Antibody chain | SEQ ID NO | Source |
|---|---|---|---|
| EGFR | VL | 4122 | |
| EGFR | VL | 4123 | |
| EGFR | VL | 4124 | |
| EGFR | VL | 4125 | |
| EGFR | VL | 4126 | |
| EGFR | VL | 4127 | |
| EGFR | VL | 4128 | |
| EGFR | VL | 4129 | |
| EGFR | VL | 4130 | |
| EGFR | VL | 4131 | |
| EGFR | VL | 4132 | |
| EGFR | VL | 4133 | |
| EGFR | VL | 4134 | |
| EGFR | VL | 4135 | |
| EGFR | VL | 4136 | |
| EGFR | VL | 4137 | |
| EGFR | VL | 4138 | |
| EGFR | VL | 4139 | |
| EGFR | VL | 4140 | |
| EGFR | VL | 4141 | |
| EGFR | VL | 4142 | |
| EGFR | VL | 4143 | |
| EGFR | VL | 4144 | |
| EGFR | VL | 4145 | |
| EGFR | VL | 4146 | |
| EGFR | VL | 4147 | |
| EGFR | VL | 4148 | |
| EGFR | VL | 4149 | |
| EGFR | VL | 4150 | |
| EGFR | VL | 4151 | |
| EGFR | VL | 4152 | |
| EGFR | VL | 4153 | |
| EGFR | VL | 4154 | |
| EGFR | VL | 4155 | |
| EGFR | VL | 4156 | |
| EGFR | VL | 4157 | |
| EGFR | VL | 4158 | |
| EGFR | VL | 4159 | |
| EGFR | VL | 4160 | |
| EGFR | VL | 4161 | |
| EGFR | VL | 4162 | |
| EGFR | VL | 4163 | |
| EGFR | VL | 4164 | |
| EGFR | VL | 4165 | |
| EGFR | VL | 4166 | |
| EGFR | VL | 4167 | |
| EGFR | VL | 4168 | |
| EGFR | VL | 4169 | |
| EGFR | VL | 4170 | |
| EGFR | VL | 4171 | |
| EGFR | VL | 4172 | |
| EGFR | VL | 4173 | |
| EGFR | VL | 4174 | |
| EGFR | VL | 4175 | |
| EGFR | VL | 4176 | |
| EGFR | VL | 4177 | |
| EGFR | VL | 4178 | |
| EGFR | VL | 4179 | |
| EGFR | VL | 4180 | |
| EGFR | VL | 4181 | |
| EGFR | VL | 4182 | |
| EGFR | VL | 4183 | |
| EGFR | VL | 4184 | |
| EGFR | VL | 4185 | |
| EGFR | VL | 4186 | |
| EGFR | VL | 4187 | |
| EGFR | VL | 4188 | |
| EGFR | VL | 4189 | |
| EGFR | VL | 4190 | |
| EGFR | VL | 4191 | |
| EGFR | VL | 4192 | |
| EGFR | VL | 4193 | |
| EGFR | VL | 4194 | |
| EGFR | VL | 4195 | |
| EGFR | VL | 4196 | |

TABLE 10-continued

Variable Heavy and Light Chain Sequences

| Target | Antibody chain | SEQ ID NO | Source |
|---|---|---|---|
| EGFR | VL | 4197 | |
| EGFR | VL | 4198 | |
| EGFR | VL | 4199 | |
| EGFR | VL | 4200 | |
| EGFR | VL | 4201 | |
| EGFR | VL | 4202 | |
| EGFR | VL | 4203 | |
| EGFR | VL | 4204 | |
| EGFR | VL | 4205 | |
| EGFR | VL | 4206 | |
| EGFR | VL | 4207 | |
| EGFR | VL | 4208 | |
| EGFR | VL | 4209 | |
| EGFR | VL | 4210 | |
| EGFR | VL | 4211 | |
| EGFR | VL | 4212 | |
| EGFR | VL | 4213 | |
| EGFR | VL | 4214 | |
| EGFR | VL | 4215 | |
| EGFR | VL | 4216 | |
| EGFR | VL | 4217 | |
| EGFR | VL | 4218 | |
| EGFR | VL | 4219 | |
| EGFR | VL | 4220 | |
| EGFR | VL | 4221 | |
| EGFR | VL | 4222 | |
| EGFR | VL | 4223 | |
| EGFR | VL | 4224 | |
| EGFR | VL | 4225 | |
| EGFR | VL | 4226 | |
| EGFR | VL | 4227 | |
| EGFR | VL | 4228 | |
| EGFR | VL | 4229 | |
| EGFR | VL | 4230 | |
| EGFR | VL | 4231 | |
| EGFR | VL | 4232 | |
| EGFR | VL | 4233 | |
| EGFR | VL | 4234 | |
| EGFR | VL | 4235 | |
| EGFR | VL | 4236 | |
| EGFR | VL | 4237 | |
| EGFR | VL | 4238 | |
| EGFR | VL | 4239 | |
| EGFR | VL | 4240 | |
| EGFR | VL | 4241 | |
| EGFR | VL | 4242 | |
| EGFR | VL | 4243 | |
| EGFR | VL | 4244 | |
| EGFR | VL | 4245 | |
| EGFR | VL | 4246 | |
| EGFR | VL | 4247 | |
| EGFR | VL | 4248 | |
| EGFR | VL | 4249 | |
| EGFR | VL | 4250 | |
| EGFR | VL | 4251 | |
| EGFR | VL | 4252 | |
| EGFR | VL | 4253 | |
| EGFR | VL | 4254 | |
| EGFR | VL | 4255 | |
| EGFR | VL | 4256 | |
| EGFR | VL | 4257 | |
| EGFR | VL | 4258 | |
| EGFR | VL | 4259 | |
| EGFR | VL | 4260 | |
| EGFR | VL | 4261 | |
| EGFR | VL | 4262 | |
| EGFR | VL | 4263 | |
| EGFR | VL | 4264 | |
| EGFR | VL | 4265 | |
| EGFR | VL | 4266 | |
| EGFR | VL | 4267 | |
| EGFR | VL | 4268 | |
| EGFR | VL | 4269 | |
| EGFR | VL | 4270 | |
| EGFR | VL | 4271 | |

TABLE 10-continued

| Variable Heavy and Light Chain Sequences | | | |
|---|---|---|---|
| Target | Antibody chain | SEQ ID NO | Source |
| EGFR | VL | 4272 | |
| EGFR | VL | 4273 | |
| EGFR | VL | 4274 | |
| EGFR | VL | 4275 | |
| EGFR | VL | 4276 | |
| EGFR | VL | 4277 | |
| EGFR | VL | 4278 | |
| EGFR | VL | 4279 | |
| EGFR | VL | 4280 | |
| EGFR | VL | 4281 | |
| EGFR | VL | 4282 | |
| EGFR | VL | 4283 | |
| EGFR | VL | 4284 | |
| EGFR | VL | 4285 | |
| EGFR | VL | 4286 | |
| EGFR | VL | 4287 | |
| EGFR | VL | 4288 | |
| EGFR | VL | 4289 | |
| EGFR | VL | 4290 | |
| EGFR | VL | 4291 | |
| EGFR | VL | 4292 | |
| EGFR | VL | 4293 | |
| EGFR | VL | 4294 | |
| EGFR | VL | 4295 | |
| EGFR | VL | 4296 | |
| EGFR | VL | 4297 | |
| EGFR | VL | 4298 | |
| EGFR | VL | 4299 | |
| EGFR | VL | 4300 | |
| EGFR | VL | 4301 | |
| EGFR | VL | 4302 | |
| EGFR | VL | 4303 | |
| EGFR | VL | 4304 | |
| EGFR | VL | 4305 | |
| EGFR | VL | 4306 | |
| EGFR | VL | 4307 | |
| EGFR | VL | 4308 | |
| EGFR | VL | 4309 | |
| EGFR | VL | 4310 | |
| EGFR | VL | 4311 | |
| EGFR | VL | 4312 | |
| EGFR | VL | 4313 | |
| EGFR | VL | 4314 | |
| EGFR | VL | 4315 | |
| EGFR | VL | 4316 | |
| EGFR | VL | 4317 | |
| EGFR | VL | 4318 | |
| EGFR | VL | 4319 | |
| EGFR | VL | 4320 | |
| EGFR | VL | 4321 | |
| EGFR | VL | 4322 | |
| EGFR | VL | 4323 | |
| EGFR | VL | 4324 | |
| EGFR | VL | 4325 | |
| EGFR | VL | 4326 | |
| EGFR | VL | 4327 | |
| EGFR | VL | 4328 | |
| EGFR | VL | 4329 | |
| EGFR | VL | 4330 | |
| EGFR | VL | 4331 | |
| EGFR | VL | 4332 | |
| EGFR | VL | 4333 | |
| EGFR | VL | 4334 | |
| EGFR | VL | 4335 | |
| EGFR | VL | 4336 | |
| EGFR | VL | 4337 | |
| EGFR | VL | 4338 | |
| EGFR | VL | 4339 | |
| EGFR | VL | 4340 | |
| EGFR | VL | 4341 | |
| EGFR | VL | 4342 | |
| EGFR | VL | 4343 | |
| EGFR | VL | 4344 | |
| EGFR | VL | 4345 | |
| EGFR | VL | 4346 | |

TABLE 10-continued

Variable Heavy and Light Chain Sequences

| Target | Antibody chain | SEQ ID NO | Source |
|---|---|---|---|
| EGFR | VL | 4347 | |
| EGFR | VL | 4348 | |
| EGFR | VL | 4349 | |
| EGFR | VL | 4350 | |
| EGFR | VL | 4351 | |
| EGFR | VL | 4352 | |
| EGFR | VL | 4353 | |
| EGFR | VL | 4354 | |
| EGFR | VL | 4355 | |
| EGFR | VL | 4356 | |
| EGFR | VL | 4357 | |
| EGFR | VL | 4358 | |
| EGFR | VL | 4359 | |
| EGFR | VL | 4360 | |
| EGFR | VL | 4361 | |
| EGFR | VL | 4362 | |
| EGFR | VL | 4363 | |
| EGFR | VL | 4364 | |
| EGFR | VL | 4365 | |
| EGFR | VL | 4366 | |
| EGFR | VL | 4367 | |
| EGFR | VL | 4368 | |
| EGFR | VL | 4369 | |
| EGFR | VL | 4370 | |
| EGFR | VL | 4371 | |
| EGFR | VL | 4372 | |
| EGFR | VL | 4373 | |
| EGFR | VL | 4374 | |
| EGFR | VL | 4375 | |
| EGFR | VL | 4376 | |
| EGFR | VL | 4377 | |
| EGFR | VL | 4378 | |
| EGFR | VL | 4379 | |
| EGFR | VL | 4380 | |
| EGFR | VL | 4381 | |
| EGFR | VL | 4382 | |
| EGFR | VL | 4383 | |
| EGFR | VL | 4384 | |
| EGFR | VL | 4385 | |
| EGFR | VL | 4386 | |
| EGFR | VL | 4387 | |
| EGFR | VL | 4388 | |
| EGFR | VL | 4389 | |
| EGFR | VL | 4390 | |
| EGFR | VL | 4391 | |
| EGFR | VL | 4392 | |
| EGFR | VL | 4393 | |
| EGFR | VL | 4394 | |
| EGFR | VL | 4395 | |
| EGFR | VL | 4396 | |
| EGFR | VL | 4397 | |
| EGFR | VL | 4398 | |
| EGFR | VL | 4399 | |
| EGFR | VL | 4400 | |
| EGFR | VL | 4401 | |
| EGFR | VL | 4402 | |
| EGFR | VL | 4403 | |
| EGFR | VL | 4404 | |
| EGFR | VL | 4405 | |
| EGFR | VL | 4406 | |
| EGFR | VL | 4407 | |
| EGFR | VL | 4408 | |
| EGFR | VL | 4409 | |
| EGFR | VL | 4410 | |
| EGFR | VL | 4411 | |
| EGFR | VL | 4412 | |
| EGFR | VL | 4413 | |
| EGFR | VL | 4414 | |
| EGFR | VL | 4415 | |
| EGFR | VL | 4416 | |
| EGFR | VL | 4417 | |
| EGFR | VL | 4418 | |
| EGFR | VL | 4419 | |
| EGFR | VL | 4420 | |
| EGFR | VL | 4421 | |

TABLE 10-continued

Variable Heavy and Light Chain Sequences

| Target | Antibody chain | SEQ ID NO | Source |
|---|---|---|---|
| EGFR | VL | 4422 | |
| EGFR | VL | 4423 | |
| EGFR | VL | 4424 | |
| EGFR | VL | 4425 | |
| EGFR | VL | 4426 | |
| EGFR | VL | 4427 | |
| EGFR | VL | 4428 | |
| EGFR | VL | 4429 | |
| EGFR | VL | 4430 | |
| EGFR | VL | 4431 | |
| EGFR | VL | 4432 | |
| EGFR | VL | 4433 | |
| EGFR | VL | 4434 | |
| EGFR | VL | 4435 | |
| EGFR | VL | 4436 | |
| EGFR | VL | 4437 | |
| EGFR | VL | 4438 | |
| EGFR | VL | 4439 | |
| EGFR | VL | 4440 | |
| EGFR | VL | 4441 | |
| EGFR | VL | 4442 | |
| EGFR | VL | 4443 | |
| EGFR | VL | 4444 | |
| EGFR | VL | 4445 | |
| EGFR | VL | 4446 | |
| EGFR | VL | 4447 | |
| EGFR | VL | 4448 | |
| EGFR | VL | 4449 | |
| EGFR | VL | 4450 | |
| EGFR | VL | 4451 | |
| EGFR | VL | 4452 | |
| EGFR | VL | 4453 | |
| EGFR | VL | 4454 | |
| EGFR | VL | 4455 | |
| EGFR | VL | 4456 | |
| EGFR | VL | 4457 | |
| EGFR | VL | 4458 | |
| EGFR | VL | 4459 | |
| EGFR | VL | 4460 | |
| EGFR | VL | 4461 | |
| EGFR | VL | 4462 | |
| EGFR | VL | 4463 | |
| EGFR | VL | 4464 | |
| EGFR | VL | 4465 | |
| EGFR | VL | 4466 | |
| EGFR | VL | 4467 | |
| EGFR | VL | 4468 | |
| EGFR | VL | 4469 | |
| EGFR | VL | 4470 | |
| EGFR | VL | 4471 | |
| EGFR | VL | 4472 | |
| EGFR | VL | 4473 | |
| EGFR | VL | 4474 | |
| EGFR | VL | 4475 | |
| EGFR | VL | 4476 | |
| EGFR | VL | 4477 | |
| EGFR | VL | 4478 | |
| EGFR | VL | 4479 | |
| EGFR | VL | 4480 | |
| EGFR | VL | 4481 | |
| EGFR | VL | 4482 | |
| EGFR | VL | 4483 | |
| EGFR | VL | 4484 | |
| EGFR | VL | 4485 | |
| EGFR | VL | 4486 | |
| EGFR | VL | 4487 | |
| EGFR | VL | 4488 | |
| EGFR | VL | 4489 | |
| EGFR | VL | 4490 | |
| EGFR | VL | 4491 | |
| EGFR | VL | 4492 | |
| EGFR | VL | 4493 | |
| EGFR | VL | 4494 | |
| EGFR | VL | 4495 | |
| EGFR | VL | 4496 | |

TABLE 10-continued

Variable Heavy and Light Chain Sequences

| Target | Antibody chain | SEQ ID NO | Source |
|---|---|---|---|
| EGFR | VL | 4497 | |
| EGFR | VL | 4498 | |
| EGFR | VL | 4499 | |
| EGFR | VL | 4500 | |
| EGFR | VL | 4501 | |
| EGFR | VL | 4502 | |
| EGFR | VL | 4503 | |
| EGFR | VL | 4504 | |
| EGFR | VL | 4505 | |
| EGFR | VL | 4506 | |
| EGFR | VL | 4507 | |
| EGFR | VL | 4508 | |
| EGFR | VL | 4509 | |
| EGFR | VL | 4510 | |
| EGFR | VL | 4511 | |
| EGFR | VL | 4512 | |
| EGFR | VL | 4513 | |
| EGFR | VL | 4514 | |
| EGFR | VL | 4515 | |
| EGFR | VL | 4516 | |
| EGFR | VL | 4517 | |
| EGFR | VL | 4518 | |
| EGFR | VL | 4519 | |
| EGFR | VL | 4520 | |
| EGFR | VL | 4521 | |
| EGFR | VL | 4522 | |
| EGFR | VL | 4523 | |
| EGFR | VL | 4524 | |
| EGFR | VL | 4525 | |
| EGFR | VL | 4526 | |
| EGFR | VL | 4527 | |
| EGFR | VL | 4528 | |
| EGFR | VL | 4529 | |
| EGFR | VL | 4530 | |
| EGFR | VL | 4531 | |
| EGFR | VL | 4532 | |
| EGFR | VL | 4533 | |
| EGFR | VL | 4534 | |
| EGFR | VL | 4535 | |
| EGFR | VL | 4536 | |
| EGFR | VL | 4537 | |
| EGFR | VL | 4538 | |
| EGFR | VL | 4539 | |
| EGFR | VL | 4540 | |
| EGFR | VL | 4541 | |
| EGFR | VL | 4542 | |
| EGFR | VL | 4543 | |
| EGFR | VL | 4544 | |
| EGFR | VL | 4545 | |
| EGFR | VL | 4546 | |
| EGFR | VL | 4547 | |
| EGFR | VL | 4548 | |
| EGFR | VL | 4549 | |
| EGFR | VL | 4550 | |
| EGFR | VL | 4551 | |
| EGFR | VL | 4552 | |
| EGFR | VL | 4553 | |
| EGFR | VL | 4554 | |
| EGFR | VL | 4555 | |
| EGFR | VL | 4556 | |
| EGFR | VL | 4557 | |
| EGFR | VL | 4558 | |
| EGFR | VL | 4559 | |
| EGFR | VL | 4560 | |
| EGFR | VL | 4561 | |
| EGFR | VL | 4562 | |
| EGFR | VL | 4563 | |
| EGFR | VL | 4564 | |
| EGFR | VL | 4565 | |
| EGFR | VL | 4566 | |
| EGFR | VL | 4567 | |
| EGFR | VL | 4568 | |
| EGFR | VL | 4569 | |
| EGFR | VL | 4570 | |
| EGFR | VL | 4571 | |

TABLE 10-continued

Variable Heavy and Light Chain Sequences

| Target | Antibody chain | SEQ ID NO | Source |
|---|---|---|---|
| EGFR | VL | 4572 | |
| EGFR | VL | 4573 | |
| EGFR | VL | 4574 | |
| EGFR | VL | 4575 | |
| EGFR | VL | 4576 | |
| EGFR | VL | 4577 | |
| EGFR | VL | 4578 | |
| EGFR | VL | 4579 | |
| EGFR | VL | 4580 | |
| EGFR | VL | 4581 | |
| EGFR | VL | 4582 | |
| EGFR | VL | 4583 | |
| EGFR | VL | 4584 | |
| EGFR | VL | 4585 | |
| EGFR | VL | 4586 | |
| EGFR | VL | 4587 | |
| EGFR | VL | 4588 | |
| EGFR | VL | 4589 | |
| EGFR | VL | 4590 | |
| EGFR | VL | 4591 | |
| EGFR | VL | 4592 | |
| EGFR | VL | 4593 | |
| EGFR | VL | 4594 | |
| EGFR | VL | 4595 | |
| EGFR | VL | 4596 | |
| EGFR | VL | 4597 | |
| EGFR | VL | 4598 | |
| EGFR | VL | 4599 | |
| EGFR | VL | 4600 | |
| EGFR | VL | 4601 | |
| EGFR | VL | 4602 | |
| EGFR | VL | 4603 | |
| EGFR | VL | 4604 | |
| EGFR | VL | 4605 | |
| EGFR | VL | 4606 | |
| EGFR | VL | 4607 | |
| EGFR | VL | 4608 | |
| EGFR | VL | 4609 | |
| EGFR | VL | 4610 | |
| EGFR | VL | 4611 | |
| EGFR | VL | 4612 | |
| EGFR | VL | 4613 | |
| EGFR | VL | 4614 | |
| EGFR | VL | 4615 | |
| EGFR | VL | 4616 | |
| EGFR | VL | 4617 | |
| EGFR | VL | 4618 | |
| EGFR | VL | 4619 | |
| EGFR | VL | 4620 | |
| EGFR | VL | 4621 | |
| EGFR | VL | 4622 | |
| EGFR | VL | 4623 | |
| EGFR | VL | 4624 | |
| EGFR | VL | 4625 | |
| EGFR | VL | 4626 | |
| EGFR | VL | 4627 | |
| EGFR | VL | 4628 | |
| EGFR | VL | 4629 | |
| EGFR | VL | 4630 | |
| EGFR | VL | 4631 | |
| EGFR | VL | 4632 | |
| EGFR | VL | 4633 | |
| EGFR | VL | 4634 | |
| EGFR | VL | 4635 | |
| EGFR | VL | 4636 | |
| EGFR | VL | 4637 | |
| EGFR | VL | 4638 | |
| EGFR | VL | 4639 | |
| EGFR(EGFRvIII) | VL | 4640 | |
| EGFR(EGFRvIII) | VL | 4641 | |
| EGFR(EGFRvIII) | VL | 4642 | |
| EGFR(EGFRvIII) | VL | 4643 | |
| EGFR(EGFRvIII) | VL | 4644 | |
| EGFR(EGFRvIII) | VL | 4645 | |
| EGFR(EGFRvIII) | VL | 4646 | |

TABLE 10-continued

Variable Heavy and Light Chain Sequences

| Target | Antibody chain | SEQ ID NO | Source |
|---|---|---|---|
| EGFR(EGFRvIII) | VL | 4647 | |
| EGFR(EGFRvIII) | VL | 4648 | |
| EGFR(EGFRvIII) | VL | 4649 | |
| EGFR(EGFRvIII) | VL | 4650 | |
| EGFR(EGFRvIII) | VL | 4651 | |
| EGFR(EGFRvIII) | VL | 4652 | |
| EGFR(EGFRvIII) | VL | 4653 | |
| EGFR(EGFRvIII) | VL | 4654 | |
| EGFR(EGFRvIII) | VL | 4655 | |
| EGFR(EGFRvIII) | VL | 4656 | |
| EGFR(EGFRvIII) | VL | 4657 | |
| EGFR(EGFRvIII) | VL | 4658 | |
| EGFRvIII | VL | 4659 | SEQ ID NO. 14 in WO2016016341 |
| EGFRvIII | VL | 4660 | SEQ ID NO: 23 in WO2016168773A3 |
| EGFRvIII | VL | 4661 | SEQ ID NO. 42 in US20160304615 |
| EGFRvIII | VL | 4662 | SEQ ID NO: 1 in US20160200819A1 |
| Endoglin | VL | 4663 | SEQ ID NO 103 in WO2011041441 |
| Endoglin | VL | 4664 | SEQ ID NO 88 in WO2011041441 |
| Endoglin | VL | 4665 | SEQ ID NO 89 in WO2011041441 |
| Endoglin | VL | 4666 | SEQ ID NO 90 in WO2011041441 |
| Endoglin | VL | 4667 | SEQ ID NO 91 in WO2011041441 |
| Endoglin | VL | 4668 | SEQ ID NO 92 in WO2011041441 |
| Endoglin | VL | 4669 | SEQ ID NO 93 in WO2011041441 |
| Endoglin | VL | 4670 | SEQ ID NO 94 in WO2011041441 |
| Endoglin | VL | 4671 | SEQ ID NO 95 in WO2011041441 |
| Endoglin | VL | 4672 | SEQ ID NO 96 in WO2011041441 |
| Endoglin | VL | 4673 | SEQ ID NO 97 in WO2011041441 |
| Endoglin | VL | 4674 | SEQ ID NO. 102 in WO2011041441 |
| Endoglin | VL | 4675 | SEQ ID NO. 100 in WO2011041441 |
| Endoglin | VL | 4676 | SEQ ID NO. 100 in US20160009811 |
| Endoglin | VL | 4677 | SEQ ID NO. 102 in US20160009811 |
| Endoglin | VL | 4678 | SEQ ID NO. 103 in US20160009811 |
| Endoglin | VL | 4679 | SEQ ID NO. 3 in US20160009811 |
| Endoglin | VL | 4680 | SEQ ID NO. 4 in US20160009811 |
| Endoglin | VL | 4681 | SEQ ID NO. 5 in US20160009811 |
| Endoglin | VL | 4682 | SEQ ID NO. 70 in US20160009811 |
| Endoglin | VL | 4683 | SEQ ID NO. 72 in US20160009811 |
| Endoglin | VL | 4684 | SEQ ID NO. 74 in US20160009811 |
| Endoglin | VL | 4685 | SEQ ID NO. 93 in US20160009811 |
| Endoglin | VL | 4686 | SEQ ID NO. 94 in US20160009811 |
| Endoglin | VL | 4687 | SEQ ID NO. 95 in US20160009811 |
| Endoglin | VL | 4688 | SEQ ID NO. 96 in US20160009811 |
| Endoglin | VL | 4689 | SEQ ID NO. 97 in US20160009811 |
| EphA2receptor | VL | 4690 | US20150274824 SEQ ID NO: 26 |
| EphA2receptor | VL | 4691 | US20150274824 SEQ ID NO: 28 |
| EphA2receptor | VL | 4692 | US20150274824 SEQ ID NO: 30 |
| EphA2receptor | VL | 4693 | US20150274824 SEQ ID NO: 47 |
| EphA2receptor | VL | 4694 | US20150274824 SEQ ID NO: 48 |
| EphA2receptor | VL | 4695 | US20150274824 SEQ ID NO: 49 |
| EphA2receptor | VL | 4696 | US20150274824 SEQ ID NO: 50 |
| EphA2receptor | VL | 4697 | US20150274824 SEQ ID NO: 52 |
| EphA2receptor | VL | 4698 | US20150274824 SEQ ID NO: 78 |
| EphA2receptor | VL | 4699 | US20150274824 SEQ ID NO: 80 |
| ERBB2 | VL | 4700 | US20110129464 SEQ ID NO: 1 |
| ERBB2 | VL | 4701 | US20130089544 SEQ ID NO: 12 |
| ERBB2 | VL | 4702 | US20130089544 SEQ ID NO: 16 |
| ERBB2 | VL | 4703 | US20130089544 SEQ ID NO: 20 |
| ERBB2 | VL | 4704 | US20130089544 SEQ ID NO: 24 |
| ERBB2 | VL | 4705 | US20130089544 SEQ ID NO: 32 |
| ERBB2 | VL | 4706 | US20130089544 SEQ ID NO: 36 |
| ERBB2 | VL | 4707 | US20130089544 SEQ ID NO: 44 |
| ERBB2 | VL | 4708 | US20130089544 SEQ ID NO: 50 |
| ERBB2 | VL | 4709 | US20130089544 SEQ ID NO: 51 |
| ERBB2 | VL | 4710 | US20130089544 SEQ ID NO: 53 |
| ERBB2 | VL | 4711 | US20130089544 SEQ ID NO: 8 |
| ERBB2 | VL | 4712 | US20130266564 SEQ ID NO: 7 |
| FactorD | VL | 4713 | SEQ ID NO. 16 in US20160017052 |
| FactorD | VL | 4714 | SEQ ID NO. 18 in US20160017052 |
| FactorD | VL | 4715 | SEQ ID NO. 19 in US20160017052 |
| FactorD | VL | 4716 | SEQ ID NO. 26 in US20160017052 |
| FactorD | VL | 4717 | SEQ ID NO. 3 in US20160017052 |
| FactorXII | VL | 4718 | SEQ ID NO. 17 in WO2014089493 |
| FAP | VL | 4719 | SEQ ID NO. 2 in WO2015118030 |
| FAP | VL | 4720 | SEQ ID NO. 6 in WO2015118030 |
| FAP | VL | 4721 | SEQ ID NO. 171 in WO2016120216 |

TABLE 10-continued

Variable Heavy and Light Chain Sequences

| Target | Antibody chain | SEQ ID NO | Source |
|---|---|---|---|
| FAP | VL | 4722 | SEQ ID NO. 173 in WO2016120216 |
| FAP | VL | 4723 | SEQ ID NO: 9 in US20160326265A1 |
| FcRL5(FcReceptorLike5) | VL | 4724 | SEQ ID NO: 11 WO2016090337 |
| FcRL5(FcReceptorLike5) | VL | 4725 | SEQ ID NO: 15 WO2016090337 |
| FcRL5(FcReceptorLike5) | VL | 4726 | SEQ ID NO: 19 WO2016090337 |
| FcRL5(FcReceptorLike5) | VL | 4727 | SEQ ID NO: 23 WO2016090337 |
| FcRL5(FcReceptorLike5) | VL | 4728 | SEQ ID NO: 27 WO2016090337 |
| FcRL5(FcReceptorLike5) | VL | 4729 | SEQ ID NO: 3 WO2016090337 |
| FcRL5(FcReceptorLike5) | VL | 4730 | SEQ ID NO: 31 WO2016090337 |
| FcRL5(FcReceptorLike5) | VL | 4731 | SEQ ID NO: 35 WO2016090337 |
| FcRL5(FcReceptorLike5) | VL | 4732 | SEQ ID NO: 39 WO2016090337 |
| FcRL5(FcReceptorLike5) | VL | 4733 | SEQ ID NO: 43 WO2016090337 |
| FcRL5(FcReceptorLike5) | VL | 4734 | SEQ ID NO: 47 WO2016090337 |
| FcRL5(FcReceptorLike5) | VL | 4735 | SEQ ID NO: 7 WO2016090337 |
| FcRL5(FcReceptorLike5) | VL | 4736 | SEQ ID NO: 917 WO2016090337 |
| FcRL5(FcReceptorLike5) | VL | 4737 | SEQ ID NO: 921 WO2016090337 |
| FGFR3 | VL | 4738 | SEQ ID NO. 133 in U.S. Pat. No. 9,499,623 |
| FGFR3 | VL | 4739 | SEQ ID NO. 135 in U.S. Pat. No. 9,499,623 |
| FGFR3 | VL | 4740 | SEQ ID NO. 137 in U.S. Pat. No. 9,499,623 |
| FGFR3 | VL | 4741 | SEQ ID NO. 139 in U.S. Pat. No. 9,499,623 |
| Frizzled Receptor | VL | 4742 | SEQ ID NO. 12 in WO2010037041 |
| Frizzled Receptor | VL | 4743 | SEQ ID NO. 14 in WO2010037041 |
| GAH | VL | 4744 | SEQ ID NO 8 in US20060057147A1 |
| GCC1 | VL | 4745 | SEQ ID NO. 4 in US20160030595A1 |
| GCC1 | VL | 4746 | SEQ ID NO. 2 in US20160030595A1 |
| GD2 | VL | 4747 | SEQ ID NO. 10 in US20130216528 |
| GD2 | VL | 4748 | SEQ ID NO. 11 in WO2015132604 |
| GD2 | VL | 4749 | SEQ ID NO. 12 in WO2015132604 |
| GD2 | VL | 4750 | SEQ ID NO. 18 in WO2016134284 |
| GD2 | VL | 4751 | SEQ ID NO. 2 in US20130216528 |
| GD2 | VL | 4752 | SEQ ID NO. 5 in US20130216528 |
| GD2 | VL | 4753 | SEQ ID NO. 7 in US20130216528 |
| GD2 | VL | 4754 | SEQ ID NO. 9 in US20130216528 |
| GD3 | VL | 4755 | SEQ ID NO: 12 in WO2016185035A1 |
| GD3 | VL | 4756 | SEQ ID NO: 14 in WO2016185035A1 |
| GD3 | VL | 4757 | SEQ ID NO: 16 in WO2016185035A1 |
| GD3 | VL | 4758 | SEQ ID NO: 18 in WO2016185035A1 |
| Glycol epitope and ErbB Bi Specific | VL | 4759 | SEQ ID No. 10 in WO2012007167A1 |
| GM2 | VL | 4760 | US20090028877 SEQ ID NO: 21 |
| GM2 | VL | 4761 | US20090028877 SEQ ID NO: 24 |
| GM2 | VL | 4762 | US20090028877 SEQ ID NO: 25 |
| GM2 | VL | 4763 | US20090028877 SEQ ID NO: 31 |
| GM2 | VL | 4764 | US20090028877 SEQ ID NO: 32 |
| GM2 | VL | 4765 | US20090028877 SEQ ID NO: 33 |
| GM2 | VL | 4766 | US20090028877 SEQ ID NO: 34 |
| GM2 | VL | 4767 | US20090028877 SEQ ID NO: 35 |
| GPC3 | VL | 4768 | SEQ ID NO: 10 in U.S. Pat. No. 9,409,994B2 |
| GPC3 | VL | 4769 | SEQ ID NO: 14 in U.S. Pat. No. 9,409,994B2 |
| GPC3 | VL | 4770 | SEQ ID NO: 16 in US20160208015A1 |
| GPC3 | VL | 4771 | SEQ ID NO: 18 in U.S. Pat. No. 9,409,994B2 |
| GPC3 | VL | 4772 | SEQ ID NO: 22 in U.S. Pat. No. 9,409,994B2 |
| GPC3 | VL | 4773 | SEQ ID NO: 24 in U.S. Pat. No. 9,409,994B2 |
| GPC3 | VL | 4774 | SEQ ID NO: 26 in U.S. Pat. No. 9,409,994B2 |
| GPC3 | VL | 4775 | SEQ ID NO: 31 in US20160208015A1 |
| GPRC5D | VL | 4776 | SEQ ID NO. 10 in WO2016090312 |
| GPRC5D | VL | 4777 | SEQ ID NO. 14 in WO2016090312 |
| GPRC5D | VL | 4778 | SEQ ID NO. 18 in WO2016090312 |
| GPRC5D | VL | 4779 | SEQ ID NO. 2 in WO2016090312 |
| GPRC5D | VL | 4780 | SEQ ID NO. 22 in WO2016090312 |
| GPRC5D | VL | 4781 | SEQ ID NO. 26 in WO2016090312 |
| GPRC5D | VL | 4782 | SEQ ID NO. 30 in WO2016090312 |
| GPRC5D | VL | 4783 | SEQ ID NO. 303 in WO2016090312 |
| GPRC5D | VL | 4784 | SEQ ID NO. 315 in WO2016090312 |
| GPRC5D | VL | 4785 | SEQ ID NO. 327 in WO2016090312 |
| GPRC5D | VL | 4786 | SEQ ID NO. 339 in WO2016090312 |
| GPRC5D | VL | 4787 | SEQ ID NO. 34 in WO2016090312 |
| GPRC5D | VL | 4788 | SEQ ID NO. 351 in WO2016090312 |
| GPRC5D | VL | 4789 | SEQ ID NO. 363 in WO2016090312 |
| GPRC5D | VL | 4790 | SEQ ID NO. 375 in WO2016090312 |
| GPRC5D | VL | 4791 | SEQ ID NO. 38 in WO2016090312 |
| GPRC5D | VL | 4792 | SEQ ID NO. 387 in WO2016090312 |
| GPRC5D | VL | 4793 | SEQ ID NO. 42 in WO2016090312 |
| GPRC5D | VL | 4794 | SEQ ID NO. 46 in WO2016090312 |
| GPRC5D | VL | 4795 | SEQ ID NO. 50 in WO2016090312 |

TABLE 10-continued

Variable Heavy and Light Chain Sequences

| Target | Antibody chain | SEQ ID NO | Source |
|---|---|---|---|
| GPRC5D | VL | 4796 | SEQ ID NO. 54 in WO2016090312 |
| GPRC5D | VL | 4797 | SEQ ID NO. 58 in WO2016090312 |
| GPRC5D | VL | 4798 | SEQ ID NO. 6 in WO2016090312 |
| GPRC5D | VL | 4799 | SEQ ID NO. 62 in WO2016090312 |
| GPRC5D | VL | 4800 | SEQ ID NO. 66 in WO2016090312 |
| GPRC5D | VL | 4801 | SEQ ID NO. 70 in WO2016090312 |
| GPRC5D | VL | 4802 | SEQ ID NO. 74 in WO2016090312 |
| GPRC5D | VL | 4803 | SEQ ID NO. 78 in WO2016090312 |
| GPRC5D | VL | 4804 | SEQ ID NO. 82 in WO2016090312 |
| GPRC5D | VL | 4805 | SEQ ID NO. 86 in WO2016090312 |
| GPRC5D | VL | 4806 | SEQ ID NO. 94 in WO2016090312 |
| Her1/her3 | VL | 4807 | SEQ ID NO: 4 of WO2016073629 |
| Her2 | VL | 4808 | SEQ ID NO: 140 in WO2016054555A2 |
| Her2 | VL | 4809 | SEQ ID NO: 261 in WO2016168773A3 |
| Her2 | VL | 4810 | SEQ ID NO: 263 in WO2016168773A3 |
| Her2 | VL | 4811 | SEQ ID NO: 265 in WO2016168773A3 |
| Her2 | VL | 4812 | SEQ ID NO: 267 in WO2016168773A3 |
| Her2 | VL | 4813 | SEQ ID NO: 269 in WO2016168773A3 |
| HER2 | VL | 4814 | SEQ ID NO. 10 in U.S. Pat. No. 9,518,118 |
| HER2 | VL | 4815 | SEQ ID NO. 18 in U.S. Pat. No. 9,518,118 |
| HER2 | VL | 4816 | SEQ ID NO. 23 in U.S. Pat. No. 9,518,118 |
| HER2 | VL | 4817 | SEQ ID NO: 3 in WO2016168769A1 |
| HER2 | VL | 4818 | SEQ ID NO: 59 in US20160333114A1 |
| HER2 | VL | 4819 | SEQ ID NO: 61 in US20160333114A1 |
| HLAG | VL | 4820 | SEQ ID NO. 18 in WO2016160622A2 |
| HLAG | VL | 4821 | SEQ ID NO. 20 in WO2016160622A2 |
| HSP70 | VL | 4822 | SEQ ID NO. 16 in WO2016120217 |
| HSP70 | VL | 4823 | SEQ ID NO. 17 in WO2016120217 |
| humanCD79b | VL | 4824 | SEQ ID NO. 28 in WO2016112870 |
| humanCD79b | VL | 4825 | SEQ ID NO. 30 in WO2016112870 |
| Human collagen VII | VL | 4826 | SEQ ID NO. 32 in WO2016112870 |
| humanERBB3 | VL | 4827 | SEQ ID NO: 10 in WO2013052745 |
| humanERBB3 | VL | 4828 | SEQ ID NO: 20 in WO2013052745 |
| humanERBB3 | VL | 4829 | SEQ ID NO: 30 in WO2013052745 |
| humanERBB3 | VL | 4830 | SEQ ID NO: 39 in WO2013052745 |
| humanERBB3 | VL | 4831 | SEQ ID NO: 46 in WO2013052745 |
| humanERBB3 | VL | 4832 | SEQ ID NO: 56 in WO2013052745 |
| humanERBB3 | VL | 4833 | SEQ ID NO: 62 in WO2013052745 |
| ICOS | VL | 4834 | SEQ ID NO. 17 in US20160215059 |
| ICOS | VL | 4835 | SEQ ID NO. 18 in US20160215059 |
| ICOS | VL | 4836 | SEQ ID NO. 20 in US20160215059 |
| ICOS | VL | 4837 | SEQ ID NO. 24 in US20160215059 |
| ICOS | VL | 4838 | SEQ ID NO. 8 in US20160215059 |
| IGFI | VL | 4839 | SEQ ID NO. 2 in WO2007118214 |
| IGFI | VL | 4840 | SEQ ID NO. 4 in WO2007118214 |
| IGFI | VL | 4841 | SEQ ID NO. 6 in WO2007118214 |
| IGFI | VL | 4842 | SEQ ID NO. 8 in WO2007118214 |
| IGFR1 | VL | 4843 | SEQ ID NO: 8 in WO2015073575A2 |
| IL13 | VL | 4844 | SEQ ID NO 303. in US20160168242 |
| IL1RAP | VL | 4845 | SEQ ID NO. 14 in WO2016020502 |
| IL1RAP | VL | 4846 | SEQ ID NO. 15 in WO2016020502 |
| IL1RAP | VL | 4847 | SEQ ID NO. 17 in WO2016020502 |
| IL1RAP | VL | 4848 | SEQ ID NO. 18 in WO2016020502 |
| IL1RAP | VL | 4849 | SEQ ID NO. 2 in WO2016020502 |
| IL1RAP | VL | 4850 | SEQ ID NO. 20 in WO2016020502 |
| IL1RAP | VL | 4851 | SEQ ID NO: 121 in WO2016179319A1 |
| IL1RAP | VL | 4852 | SEQ ID NO: 123 in WO2016179319A1 |
| IL1RAP | VL | 4853 | SEQ ID NO: 125 in WO2016179319A1 |
| IL33 | VL | 4854 | SEQ ID NO 135. in US20160168242 |
| IL33 | VL | 4855 | SEQ ID NO 137. in US20160168242 |
| IL33 | VL | 4856 | SEQ ID NO 139. in US20160168242 |
| IL33 | VL | 4857 | SEQ ID NO 184. in US20160168242 |
| IL33 | VL | 4858 | SEQ ID NO 188. in US20160168242 |
| IL33 | VL | 4859 | SEQ ID NO 217. in US20160168242 |
| IL33 | VL | 4860 | SEQ ID NO 219. in US20160168242 |
| IL33 | VL | 4861 | SEQ ID NO 237. in US20160168242 |
| IL33 | VL | 4862 | SEQ ID NO 247. in US20160168242 |
| IL33 | VL | 4863 | SEQ ID NO 283. in US20160168242 |
| IL33 | VL | 4864 | SEQ ID NO 285. in US20160168242 |
| IL33 | VL | 4865 | SEQ ID NO 287. in US20160168242 |
| IL33 | VL | 4866 | SEQ ID NO 37. in US20160168242 |
| IL33 | VL | 4867 | SEQ ID NO 39. in US20160168242 |
| IL33 | VL | 4868 | SEQ ID NO 41. in US20160168242 |
| IL33 | VL | 4869 | SEQ ID NO 87. in US20160168242 |
| IL3alpha | VL | 4870 | SEQ ID NO. 27 in WO2008127735 |

TABLE 10-continued

Variable Heavy and Light Chain Sequences

| Target | Antibody chain | SEQ ID NO | Source |
|---|---|---|---|
| IL3alpha | VL | 4871 | SEQ ID NO. 37 in WO2008127735 |
| Integrin | VL | 4872 | SEQ ID NO. 10 in US 20140161794 |
| Integrin | VL | 4873 | SEQ ID NO. 11 in US 20140161794 |
| Integrin | VL | 4874 | SEQ ID NO. 8 in US 20140161794 |
| Integrin | VL | 4875 | SEQ ID NO. 9 in US 20140161794 |
| KDR | VL | 4876 | SEQ ID NO. 22 IN WO2003075840 |
| KIR(Lirilumab) | VL | 4877 | SEQ ID NO. 5 in US20150290316 |
| KIR(Lirilumab) | VL | 4878 | SEQ ID NO. 2 in WO2014055648 |
| KIR2DL1andKIR2DL2/3 | VL | 4879 | SEQ ID NO: 37 in WO2016126213A1 |
| K1on43 | VL | 4880 | SEQ ID NO: 48 in WO2016097231 |
| KMA | VL | 4881 | SEQ ID NO: 2 in WO2016172703A2 |
| KMA | VL | 4882 | SEQ ID NO: 21 in WO2016172703A2 |
| LAG3 | VL | 4883 | SEQ ID NO. 32 in US20150259420 |
| LAG3 | VL | 4884 | SEQ ID NO. 36 in US20150259420 |
| LAG3 | VL | 4885 | SEQ ID NO. 40 in US20150259420 |
| LAG3 | VL | 4886 | SEQ ID NO. 44 in US20150259420 |
| LAG3 | VL | 4887 | SEQ ID NO. 48 in US20150259420 |
| LAG3 | VL | 4888 | SEQ ID NO. 52 in US20150259420 |
| LAG3 | VL | 4889 | SEQ ID NO. 56 in US20150259420 |
| LAG3 | VL | 4890 | SEQ ID NO. 60 in US20150259420 |
| LAG3 | VL | 4891 | SEQ ID NO. 84 in US20150259420 |
| LAG3 | VL | 4892 | SEQ ID NO. 88 in US20150259420 |
| LAG3 | VL | 4893 | SEQ ID NO. 92 in US20150259420 |
| LAG3 | VL | 4894 | SEQ ID NO. 96 in US20150259420 |
| LAG3 | VL | 4895 | SEQ ID NO. 134 in US20150259420 |
| LAG3 | VL | 4896 | SEQ ID NO. 34 in US20150259420 |
| LAG3 | VL | 4897 | SEQ ID NO. 38 in US20150259420 |
| LAG3 | VL | 4898 | SEQ ID NO. 42 in US20150259420 |
| LAG3 | VL | 4899 | SEQ ID NO. 46 in US20150259420 |
| LAG3 | VL | 4900 | SEQ ID NO. 50 in US20150259420 |
| LAG3 | VL | 4901 | SEQ ID NO. 54 in US20150259420 |
| LAG3 | VL | 4902 | SEQ ID NO. 58 in US20150259420 |
| LAG3 | VL | 4903 | SEQ ID NO. 62 in US20150259420 |
| LAG3 | VL | 4904 | SEQ ID NO. 86 in US20150259420 |
| LAG3 | VL | 4905 | SEQ ID NO. 90 in US20150259420 |
| LAG3 | VL | 4906 | SEQ ID NO. 94 in US20150259420 |
| LAG3 | VL | 4907 | SEQ ID NO. 98 in US20150259420 |
| LAG3 | VL | 4908 | SEQ ID NO. 2 in WO2015042246 |
| leukocytegenA1 | VL | 4909 | SEQ ID NO. 24 in WO2010065962A2 |
| LGR4 | VL | 4910 | SEQ ID NO. 10 in US20160046723 |
| LGR4 | VL | 4911 | SEQ ID NO. 11 in US20160046723 |
| LGR4 | VL | 4912 | SEQ ID NO. 6 in US20160046723 |
| LGR5 | VL | 4913 | SEQ ID NO. 15 in US20160102146 |
| LGR5 | VL | 4914 | SEQ ID NO. 19 in US20160102146 |
| LGR5 | VL | 4915 | SEQ ID NO. 21 in US20160102146 |
| LGR5 | VL | 4916 | SEQ ID NO. 23 in US20160102146 |
| LGR5 | VL | 4917 | SEQ ID NO. 25 in US20160102146 |
| LGR5 | VL | 4918 | SEQ ID NO. 3 in US20160102146 |
| 1L4R | VL | 4919 | SEQ ID NO. 13 in WO2009121847 |
| 1L4R | VL | 4920 | SEQ ID NO. 7 in WO2009121847 |
| 1L4R | VL | 4921 | SEQ ID NO. 8 in WO2009121847 |
| Lymphotoxin beta receptor | VL | 4922 | SEQ ID NO. 1 in WO2004002431 |
| Lymphotoxin beta receptor | VL | 4923 | SEQ ID NO. 15 in WO2004002431 |
| Lymphotoxin beta receptor | VL | 4924 | SEQ ID NO. 4 in WO2004002431 |
| Lymphotoxin beta receptor | VL | 4925 | SEQ ID NO. 6 in WO2004002431 |
| Lymphotoxin beta receptor | VL | 4926 | SEQ ID NO. 8 in WO2004002431 |
| Lysyloxidaselike2 | VL | 4927 | SEQ ID NO. 43 in WO2011097513 |
| Lysyloxidaselike2 | VL | 4928 | SEQ ID NO. 45 in WO2011097513 |
| MCAM | VL | 4929 | SEQ ID NO. 109 in US20150259419 |
| MCAM | VL | 4930 | SEQ ID NO. 110 in US20150259419 |
| MCAM | VL | 4931 | SEQ ID NO. 111 in US20150259419 |
| MCAM | VL | 4932 | SEQ ID NO. 112 in US20150259419 |
| MCAM | VL | 4933 | SEQ ID NO. 121 in US20150259419 |
| MCAM | VL | 4934 | SEQ ID NO. 122 in US20150259419 |
| MCAM | VL | 4935 | SEQ ID NO. 123 in US20150259419 |
| MCAM | VL | 4936 | SEQ ID NO. 30 in US20150239980 |
| MCAM | VL | 4937 | SEQ ID NO. 40 in US20150239980 |
| MCAM | VL | 4938 | SEQ ID NO. 50 in US20150239980 |
| MCAM | VL | 4939 | SEQ ID NO. 60 in US20150239980 |
| MCAM | VL | 4940 | SEQ ID NO. 70 in US20150239980 |
| MCAM | VL | 4941 | SEQ ID NO. 71 in US20150239980 |
| MCAM | VL | 4942 | SEQ ID NO. 72 in US20150239980 |
| MCSF | VL | 4943 | SEQ ID NO: 8 in WO2005030124 |
| MCSF | VL | 4944 | SEQ ID NO 32 in WO2005030124 |
| MCSF | VL | 4945 | SEQ ID NO 52 in WO2005030124 |

TABLE 10-continued

Variable Heavy and Light Chain Sequences

| Target | Antibody chain | SEQ ID NO | Source |
|---|---|---|---|
| MCSF | VL | 4946 | SEQ ID NO 60 in WO2005030124 |
| MCSF | VL | 4947 | SEQ ID NO 28 in WO2005030124 |
| MCSF | VL | 4948 | SEQ ID NO 36 in WO2005030124 |
| MCSF | VL | 4949 | SEQ ID NO 4 in WO2005030124 |
| MCSF | VL | 4950 | SEQ ID NO 44 in WO2005030124 |
| MCSF | VL | 4951 | SEQ ID NO 48 in WO2005030124 |
| MCSF | VL | 4952 | SEQ ID NO 56 in WO2005030124 |
| MCSF | VL | 4953 | SEQ ID NO 62 in WO2005030124 |
| MCSF | VL | 4954 | SEQ ID NO: 12 in WO2005030124 |
| MCSF | VL | 4955 | SEQ ID NO: 16 in WO2005030124 |
| MCSF | VL | 4956 | SEQ ID NO: 20 in WO2005030124 |
| MCSF | VL | 4957 | SEQ ID NO: 24 in WO2005030124 |
| Mesothelin | VL | 4958 | SEQ ID NO. 3 WO2015188141 |
| Mesothelin | VL | 4959 | SEQ ID NO. 5 WO2015188141 |
| Mesothelin | VL | 4960 | SEQ ID NO: 1 in WO2013142034 |
| Mesothelin | VL | 4961 | SEQ ID NO: 11 in US20160229919A1 |
| Mesothelin | VL | 4962 | SEQ ID NO: 120 in US20160333114A1 |
| Mesothelin | VL | 4963 | SEQ ID NO: 15 in US20160229919A1 |
| Mesothelin | VL | 4964 | SEQ ID NO: 19 in US20160229919A1 |
| Mesothelin | VL | 4965 | SEQ ID NO: 2 in WO2013142034 |
| Mesothelin | VL | 4966 | SEQ ID NO: 23 in US20160229919A1 |
| Mesothelin | VL | 4967 | SEQ ID NO: 27 in US20160229919A1 |
| Mesothelin | VL | 4968 | SEQ ID NO: 3 in WO2013142034 |
| Mesothelin | VL | 4969 | SEQ ID NO: 47 in US20160333114A1 |
| Mesothelin | VL | 4970 | SEQ ID NO: 49 in US20160333114A1 |
| MN | VL | 4971 | SEQ ID NO. 134 in WO2007070538 |
| MN | VL | 4972 | SEQ ID NO. 136 in WO2007070538 |
| MN | VL | 4973 | SEQ ID NO. 138 in WO2007070538 |
| MN | VL | 4974 | SEQ ID NO. 140 in WO2007070538 |
| MN | VL | 4975 | SEQ ID NO. 142 in WO2007070538 |
| MN | VL | 4976 | SEQ ID NO. 144 in WO2007070538 |
| MN | VL | 4977 | SEQ ID NO. 146 in WO2007070538 |
| MN | VL | 4978 | SEQ ID NO. 148 in WO2007070538 |
| MN | VL | 4979 | SEQ ID NO. 150 in WO2007070538 |
| MN | VL | 4980 | SEQ ID NO. 152 in WO2007070538 |
| MPER | VL | 4981 | SEQ ID NO: 12 in US20160194375A1 |
| MUC1 | VL | 4982 | SEQ ID NO. 7 in US20160130357 |
| MUC1 | VL | 4983 | SEQ ID NO: 16 in WO2013023162 |
| MUC1 | VL | 4984 | SEQ ID NO: 7 in WO2013023162 |
| MUC1 | VL | 4985 | SEQ ID NO. 17 in WO2015116753 |
| MUC1 | VL | 4986 | SEQ ID NO. 21 in WO2015116753 |
| MUC1 | VL | 4987 | SEQ ID NO. 25 in WO2015116753 |
| MUC1 | VL | 4988 | SEQ ID NO. 62 in WO2015116753 |
| MUC1 | VL | 4989 | SEQ ID NO. 66 in WO2015116753 |
| MUC1 | VL | 4990 | SEQ ID NO. 70 in WO2015116753 |
| MUC16 | VL | 4991 | SEQ ID NO. 2 in WO2016149368 |
| MUC16 | VL | 4992 | SEQ ID NO. 22 in WO2016149368 |
| MUC16 | VL | 4993 | SEQ ID NO. 42 in WO2016149368 |
| MUC16 | VL | 4994 | SEQ ID NO. 62 in WO2016149368 |
| MUC16 | VL | 4995 | SEQ ID NO. 82 in WO2016149368 |
| MUC1C/ECD | VL | 4996 | SEQ ID NO: 17 in US20160340442A1 |
| MUC1C/ECD | VL | 4997 | SEQ ID NO: 21 in US20160340442A1 |
| MUC1C/ECD | VL | 4998 | SEQ ID NO: 25 in US20160340442A1 |
| MUC1C/ECD | VL | 4999 | SEQ ID NO: 62 in US20160340442A1 |
| MUC1C/ECD | VL | 5000 | SEQ ID NO: 66 in US20160340442A1 |
| MUC1C/ECD | VL | 5001 | SEQ ID NO: 70 in US20160340442A1 |
| MUC1C/ECD | VL | 5002 | SEQ ID NO: 75 in US20160340442A1 |
| MUCIN1 | VL | 5003 | SEQ ID NO: 148 in EP3049812A2 |
| MUCIN1 | VL | 5004 | SEQ ID NO: 158 in EP3049812A2 |
| MUCIN1 | VL | 5005 | SEQ ID NO: 162 in EP3049812A2 |
| MUCIN1 | VL | 5006 | SEQ ID NO: 167 in EP3049812A2 |
| MUCIN1 | VL | 5007 | SEQ ID NO: 170 in EP3049812A2 |
| MUCIN1 | VL | 5008 | SEQ ID NO: 174 in EP3049812A2 |
| MUCIN1 | VL | 5009 | SEQ ID NO: 184 in EP3049812A2 |
| MUCIN1 | VL | 5010 | SEQ ID NO: 190 in EP3049812A2 |
| MUCIN1 | VL | 5011 | SEQ ID NO: 193 in EP3049812A2 |
| MUCIN1 | VL | 5012 | SEQ ID NO: 203 in EP3049812A2 |
| MUCIN1 | VL | 5013 | SEQ ID NO: 208 in EP3049812A2 |
| MUCIN1 | VL | 5014 | SEQ ID NO: 211 in EP3049812A2 |
| MUCIN1 | VL | 5015 | SEQ ID NO: 220 in EP3049812A2 |
| MUCIN1 | VL | 5016 | SEQ ID NO: 225 in EP3049812A2 |
| MUCIN1 | VL | 5017 | SEQ ID NO: 229 in EP3049812A2 |
| MUCIN1 | VL | 5018 | SEQ ID NO: 234 in EP3049812A2 |
| MUCIN1 | VL | 5019 | SEQ ID NO: 242 in EP3049812A2 |
| MUCIN1 | VL | 5020 | SEQ ID NO: 246 in EP3049812A2 |

TABLE 10-continued

Variable Heavy and Light Chain Sequences

| Target | Antibody chain | SEQ ID NO | Source |
|---|---|---|---|
| MUCIN1 | VL | 5021 | SEQ ID NO: 250 in EP3049812A2 |
| MUCIN1 | VL | 5022 | SEQ ID NO: 255 in EP3049812A2 |
| MUCIN1 | VL | 5023 | SEQ ID NO: 261 in EP3049812A2 |
| MUCIN1 | VL | 5024 | SEQ ID NO: 270 in EP3049812A2 |
| MUCIN1 | VL | 5025 | SEQ ID NO: 275 in EP3049812A2 |
| MUCIN1 | VL | 5026 | SEQ ID NO: 279 in EP3049812A2 |
| MUCIN1 | VL | 5027 | SEQ ID NO: 283 in EP3049812A2 |
| MUCIN1 | VL | 5028 | SEQ ID NO: 291 in EP3049812A2 |
| MUCIN1 | VL | 5029 | SEQ ID NO: 297 in EP3049812A2 |
| MUCIN1 | VL | 5030 | SEQ ID NO: 303 in EP3049812A2 |
| MUCIN1 | VL | 5031 | SEQ ID NO: 308 in EP3049812A2 |
| MUCIN1 | VL | 5032 | SEQ ID NO: 315 in EP3049812A2 |
| MUCIN1 | VL | 5033 | SEQ ID NO: 319 in EP3049812A2 |
| MUCIN1 | VL | 5034 | SEQ ID NO: 323 in EP3049812A2 |
| MUCIN1 | VL | 5035 | SEQ ID NO: 333 in EP3049812A2 |
| MUCIN1 | VL | 5036 | SEQ ID NO: 340 in EP3049812A2 |
| MVR | VL | 5037 | SEQ ID NO: 5 in US20160257762A1 |
| N Glycan | VL | 5038 | SEQ ID NO: 6 in US20160194375A1 |
| N Glycan | VL | 5039 | SEQ ID NO: 8 in US20160194375A1 |
| NKG2A | VL | 5040 | SEQIDNO: 33 in WO2016126213A1 |
| NKG2A | VL | 5041 | SEQ ID NO. 7 in WO2016041947 |
| NKG2D | VL | 5042 | SEQ ID NO. 134 in WO2016122701 |
| NKG2D | VL | 5043 | SEQ ID NO. 136 in WO2016122701 |
| NOTCH1 | VL | 5044 | SEQ ID NO: 16 in WO2013074596 |
| NOTCH1 | VL | 5045 | SEQ ID NO: 20 in WO2013074596 |
| NOTCH2/3 | VL | 5046 | SEQ ID NO: 31 in WO2013074596 |
| Notch 1 | VL | 5047 | SEQ ID NO: 55 in US20160333114A1 |
| Notch 1 | VL | 5048 | SEQ ID NO: 57 in US20160333114A1 |
| Notum | VL | 5049 | SEQ ID NO: 332 in WO2012027723 |
| Notum | VL | 5050 | SEQ ID NO: 58 in WO2012027723 |
| NYBR1 | VL | 5051 | SEQ ID NO: 18 in US20160333422A1 |
| Olfml3 | VL | 5052 | SEQ ID NO. 2 in WO2015054441A1 |
| Olfml3 | VL | 5053 | SEQ ID NO. 20 in WO2015054441A1 |
| Olfml3 | VL | 5054 | SEQ ID NO. 4 in WO2015054441A1 |
| Oncofetal fibronectin | VL | 5055 | SEQ ID NO 1 in US20070202103A1 |
| Oncofetal fibronectin | VL | 5056 | SEQ ID NO 2 in US20070202103A1 |
| Oncofetal fibronectin | VL | 5057 | SEQ ID NO 7 in US20070202103A1 |
| Osteonectin | VL | 5058 | SEQ ID NO. 59 in WO2016112870 |
| OTK3 | VL | 5059 | SEQ ID NO. 18 in WO2015158868 |
| OX40 | VL | 5060 | SEQ ID NO. 10 in U.S. Pat. No. 8,283,450 |
| OX40 | VL | 5061 | SEQ ID NO. 11 in U.S. Pat. No. 9,428,570 |
| OX40 | VL | 5062 | SEQ ID NO. 116 in WO2016196228 |
| OX40 | VL | 5063 | SEQ ID NO. 120 in WO2016196228 |
| OX40 | VL | 5064 | SEQ ID NO. 122 in WO2016196228 |
| OX40 | VL | 5065 | SEQ ID NO. 24 in U.S. Pat. No. 8,748,585 |
| OX40 | VL | 5066 | SEQ ID NO. 26 in U.S. Pat. No. 8,748,585 |
| OX40 | VL | 5067 | SEQ ID NO. 27 in U.S. Pat. No. 8,748,585 |
| OX40 | VL | 5068 | SEQ ID NO. 28 in U.S. Pat. No. 8,748,585 |
| OX40 | VL | 5069 | SEQ ID NO. 30 in US20160137740 |
| OX40 | VL | 5070 | SEQ ID NO. 30 in U.S. Pat. No. 8,748,585 |
| OX40 | VL | 5071 | SEQ ID NO. 30 in WO2016196228 |
| OX40 | VL | 5072 | SEQ ID NO. 32 in US20150190506 |
| OX40 | VL | 5073 | SEQ ID NO. 32 in US20160137740 |
| OX40 | VL | 5074 | SEQ ID NO. 35 in US20150190506 |
| OX40 | VL | 5075 | SEQ ID NO. 38 in WO2016196228 |
| OX40 | VL | 5076 | SEQ ID NO. 39 in US20150190506 |
| OX40 | VL | 5077 | SEQ ID NO. 41 in US20150190506 |
| OX40 | VL | 5078 | SEQ ID NO. 43 in US20150190506 |
| OX40 | VL | 5079 | SEQ ID NO. 45 in US20150190506 |
| OX40 | VL | 5080 | SEQ ID NO. 45 in U.S. Pat. No. 8,283,450 |
| OX40 | VL | 5081 | SEQ ID NO. 47 in US20150190506 |
| OX40 | VL | 5082 | SEQ ID NO. 47 in U.S. Pat. No. 8,283,450 |
| OX40 | VL | 5083 | SEQ ID NO. 49 in US20150190506 |
| OX40 | VL | 5084 | SEQ ID NO. 49 in U.S. Pat. No. 8,283,450 |
| OX40 | VL | 5085 | SEQ ID NO. 49 in WO2016196228 |
| OX40 | VL | 5086 | SEQ ID NO. 51 in US20150190506 |
| OX40 | VL | 5087 | SEQ ID NO. 52 in US20150190506 |
| OX40 | VL | 5088 | SEQ ID NO. 56 in US20150190506 |
| OX40 | VL | 5089 | SEQ ID NO. 57 in US20150190506 |
| OX40 | VL | 5090 | SEQ ID NO. 57 in WO2016196228 |
| OX40 | VL | 5091 | SEQ ID NO. 60 in U.S. Pat. No. 8,748,585 |
| OX40 | VL | 5092 | SEQ ID NO. 62 in US20150190506 |
| OX40 | VL | 5093 | SEQ ID NO. 65 in WO2016196228 |
| OX40 | VL | 5094 | SEQ ID NO. 7 in U.S. Pat. No. 9,428,570 |
| OX40 | VL | 5095 | SEQ ID NO. 73 in WO2016196228 |

TABLE 10-continued

Variable Heavy and Light Chain Sequences

| Target | Antibody chain | SEQ ID NO | Source |
|---|---|---|---|
| OX40 | VL | 5096 | SEQ ID NO. 8 in U.S. Pat. No. 8,283,450 |
| OX40 | VL | 5097 | SEQ ID NO. 8 in U.S. Pat. No. 8,748,585 |
| OX40 | VL | 5098 | SEQ ID NO. 81 in U.S. Pat. No. 8,748,585 |
| OX40 | VL | 5099 | SEQ ID NO. 82 in U.S. Pat. No. 8,748,585 |
| OX40 | VL | 5100 | SEQ ID NO. 83 in U.S. Pat. No. 8,748,585 |
| OX40 | VL | 5101 | SEQ ID NO. 84 in U.S. Pat. No. 8,748,585 |
| OX40 | VL | 5102 | SEQ ID NO. 84 in WO2016196228 |
| OX40 | VL | 5103 | SEQ ID NO. 85 in U.S. Pat. No. 8,748,585 |
| OX40 | VL | 5104 | SEQ ID NO. 86 in U.S. Pat. No. 8,748,585 |
| OX40 | VL | 5105 | SEQ ID NO. 86 in WO2016196228 |
| OX40 | VL | 5106 | SEQ ID NO. 87 in U.S. Pat. No. 8,748,585 |
| OX40 | VL | 5107 | SEQ ID NO. 88 in U.S. Pat. No. 8,748,585 |
| OX40 | VL | 5108 | SEQ ID NO. 89 in U.S. Pat. No. 8,748,585 |
| OX40 | VL | 5109 | SEQ ID NO. 94 in WO2016196228 |
| OX40 | VL | 5110 | SEQ ID NO. 98 in WO2016196228 |
| PD1 | VL | 5111 | SEQ ID NO. 2 in US 20160159905 |
| PD1 | VL | 5112 | SEQ ID NO. 21 in US20150290316 |
| PD1 | VL | 5113 | SEQ ID NO. 30 in US20130291136 |
| PD1 | VL | 5114 | SEQ ID NO. 31 in US20130291136 |
| PD1 | VL | 5115 | SEQ ID NO. 32 in US20130291136 |
| PD1 | VL | 5116 | SEQ ID NO. 33 in US20130291136 |
| PD1 | VL | 5117 | SEQ ID NO. 39 in US 20160159905 |
| PD1 | VL | 5118 | SEQ ID NO. 42 in WO2015112900 |
| PD1 | VL | 5119 | SEQ ID NO. 46 in WO2015112900 |
| PD1 | VL | 5120 | SEQ ID NO. 54 in WO2015112900 |
| PD1 | VL | 5121 | SEQ ID NO. 58 in WO2015112900 |
| PD1 | VL | 5122 | SEQ ID NO. 62 in WO2015112900 |
| PD1 | VL | 5123 | SEQ ID NO. 66 in WO2015112900 |
| PD1 | VL | 5124 | SEQ ID NO. 7 in US 20160159905 |
| PD1 | VL | 5125 | SEQ ID NO. 70 in WO2015112900 |
| PD1 | VL | 5126 | SEQ ID NO. 74 in WO2015112900 |
| PD1 | VL | 5127 | SEQ ID NO. 78 in WO2015112900 |
| PD1 | VL | 5128 | SEQ ID NO. 8 in US 20160159905 |
| PD1 | VL | 5129 | SEQ ID NO. 9 in US 20160159905 |
| PD1 | VL | 5130 | SEQ ID NO. 18 in WO2014055648 |
| PD1(Nivolumab) | VL | 5131 | SEQ ID NO. 11 in US20150190506 |
| PD1(Pembrolizumab) | VL | 5132 | SEQ ID NO. 5 in WO2016040892 |
| PD1(Pembrolizumab) | VL | 5133 | SEQ ID NO. 13 in US20150190506 |
| PDK1 | VL | 5134 | SEQ ID NO. 9 in WO2016090365 |
| PDL1 | VL | 5135 | SEQ ID NO. 22 in WO2016061142 |
| PDL1 | VL | 5136 | SEQ ID NO. 26 in WO2016061142 |
| PDL1 | VL | 5137 | SEQ ID NO. 30 in US20150190506 |
| PDL1 | VL | 5138 | SEQ ID NO. 34 in WO2016061142 |
| PDL1 | VL | 5139 | SEQ ID NO. 42 in WO2016061142 |
| PDL1 | VL | 5140 | SEQ ID NO. 58 in WO2016061142 |
| PDL1 | VL | 5141 | SEQ ID NO. 66 in WO2016061142 |
| PDL1 | VL | 5142 | SEQ ID NO. 7 in US20160319022 |
| PDL1 | VL | 5143 | SEQ ID NO. 74 in WO2016061142 |
| PDL1 | VL | 5144 | SEQ ID NO. 8 in US20150190506 |
| PDL1 | VL | 5145 | SEQ ID NO. 82 in WO2016061142 |
| PDL1 | VL | 5146 | SEQ ID NO. 86 in WO2016061142 |
| PDL1 | VL | 5147 | SEQ ID NO. 9 in US20150190506 |
| PDL1 | VL | 5148 | SEQ ID NO. 9 in US20160319022 |
| PDL1 | VL | 5149 | US20160108123 SEQ ID NO: 17 |
| PDL1 | VL | 5150 | US20160108123 SEQ ID NO: 22 |
| PDL1 | VL | 5151 | US20160108123 SEQ ID NO: 24 |
| PDL1 | VL | 5152 | US20160108123 SEQ ID NO: 249 |
| PDL1 | VL | 5153 | US20160108123 SEQ ID NO: 26 |
| PDL1 | VL | 5154 | US20160108123 SEQ ID NO: 28 |
| PDL1 | VL | 5155 | US20160108123 SEQ ID NO: 309 |
| PDL1 | VL | 5156 | US20160108123 SEQ ID NO: 311 |
| PDL1 | VL | 5157 | US20160108123 SEQ ID NO: 313 |
| PDL1 | VL | 5158 | US20160108123 SEQ ID NO: 320 |
| PDL1 | VL | 5159 | US20160108123 SEQ ID NO: 325 |
| PDL1 | VL | 5160 | US20160108123 SEQ ID NO: 34 |
| PDL1 | VL | 5161 | US20160108123 SEQ ID NO: 340 |
| PDL1 | VL | 5162 | US20160108123 SEQ ID NO: 357 |
| PDL1 | VL | 5163 | US20160108123 SEQ ID NO: 359 |
| PDL1 | VL | 5164 | US20160108123 SEQ ID NO: 36 |
| PDL1 | VL | 5165 | US20160108123 SEQ ID NO: 42 |
| PDL1 | VL | 5166 | US20160108123 SEQ ID NO: 44 |
| PDL1 | VL | 5167 | US20160108123 SEQ ID NO: 58 |
| PDL1 | VL | 5168 | US20160108123 SEQ ID NO: 60 |
| PDL1 | VL | 5169 | US20160108123 SEQ ID NO: 66 |
| PDL1 | VL | 5170 | US20160108123 SEQ ID NO: 68 |

TABLE 10-continued

Variable Heavy and Light Chain Sequences

| Target | Antibody chain | SEQ ID NO | Source |
|---|---|---|---|
| PDL1 | VL | 5171 | US20160108123 SEQ ID NO: 74 |
| PDL1 | VL | 5172 | US20160108123 SEQ ID NO: 76 |
| PDL1 | VL | 5173 | US20160108123 SEQ ID NO: 8 |
| PDL1 | VL | 5174 | US20160108123 SEQ ID NO: 82 |
| PDL1 | VL | 5175 | US20160108123 SEQ ID NO: 84 |
| PDL1 | VL | 5176 | US20160108123 SEQ ID NO: 86 |
| PDL1 | VL | 5177 | US20160108123 SEQ ID NO: 88 |
| PDL2 | VL | 5178 | SEQ ID NO. 47 in US20130291136 |
| PDL2 | VL | 5179 | SEQ ID NO. 48 in US20130291136 |
| PDL2 | VL | 5180 | SEQ ID NO. 49 in US20130291136 |
| PDL2 | VL | 5181 | SEQ ID NO. 50 in US20130291136 |
| PDL2 | VL | 5182 | SEQ ID NO. 51 in US20130291136 |
| PG16 | VL | 5183 | SEQ ID NO: 12 in EP3074419A2 |
| PG9 | VL | 5184 | SEQ ID NO: 10 in EP3074419A2 |
| PGT2 | VL | 5185 | SEQ ID NO: 16 in EP3074419A2 |
| PGT3 | VL | 5186 | SEQ ID NO: 18 in EP3074419A2 |
| PGT4 | VL | 5187 | SEQ ID NO: 20 in EP3074419A2 |
| PGT5 | VL | 5188 | SEQ ID NO: 22 in EP3074419A2 |
| PRAME | VL | 5189 | SEQ ID NO: 49 in WO2016191246A2 |
| PRAME | VL | 5190 | SEQ ID NO: 51 in WO2016191246A2 |
| PRAME | VL | 5191 | SEQ ID NO: 53 in WO2016191246A2 |
| PRAME | VL | 5192 | SEQ ID NO: 55 in WO2016191246A2 |
| PRAME | VL | 5193 | SEQ ID NO: 57 in WO2016191246A2 |
| PRAME | VL | 5194 | SEQ ID NO: 59 in WO2016191246A2 |
| PRAME | VL | 5195 | SEQ ID NO: 61 in WO2016191246A2 |
| PRP | VL | 5196 | SEQ ID NO: 39 in US20160333114A1 |
| PRP | VL | 5197 | SEQ ID NO: 41 in US20160333114A1 |
| PSMA | VL | 5198 | SEQ ID NO: 44 in WO2016097231 |
| PTK7 | VL | 5199 | SEQ ID NO. 20 in WO2012112943A1 |
| PTK7 | VL | 5200 | SEQ ID NO. 22 in WO2012112943A1 |
| PTK7 | VL | 5201 | SEQ ID NO. 24 in WO2012112943A1 |
| PTK7 | VL | 5202 | SEQ ID NO. 26 in WO2012112943A1 |
| PTK7 | VL | 5203 | SEQ ID NO. 28 in WO2012112943A1 |
| PTK7 | VL | 5204 | SEQ ID NO. 30 in WO2012112943A1 |
| PTK7 | VL | 5205 | SEQ ID NO. 32 in WO2012112943A1 |
| PTK7 | VL | 5206 | SEQ ID NO. 34 in WO2012112943A1 |
| PTK7 | VL | 5207 | SEQ ID NO. 36 in WO2012112943A1 |
| PTK7 | VL | 5208 | SEQ ID NO. 38 in WO2012112943A1 |
| PTK7 | VL | 5209 | SEQ ID NO. 40 in WO2012112943A1 |
| PTK7 | VL | 5210 | SEQ ID NO. 42 in WO2012112943A1 |
| PTK7 | VL | 5211 | SEQ ID NO. 44 in WO2012112943A1 |
| PTK7 | VL | 5212 | SEQ ID NO. 46 in WO2012112943A1 |
| PTK7 | VL | 5213 | SEQ ID NO. 48 in WO2012112943A1 |
| PTK7 | VL | 5214 | SEQ ID NO. 50 in WO2012112943A1 |
| PTK7 | VL | 5215 | SEQ ID NO. 52 in WO2012112943A1 |
| PTK7 | VL | 5216 | SEQ ID NO. 54 in WO2012112943A1 |
| PTK7 | VL | 5217 | SEQ ID NO. 56 in WO2012112943A1 |
| PTK7 | VL | 5218 | SEQ ID NO. 58 in WO2012112943A1 |
| PTK7 | VL | 5219 | SEQ ID NO. 60 in WO2012112943A1 |
| PTK7 | VL | 5220 | SEQ ID NO. 62 in WO2012112943A1 |
| PTK7 | VL | 5221 | SEQ ID NO. 64 in WO2012112943A1 |
| PTK7 | VL | 5222 | SEQ ID NO. 66 in WO2012112943A1 |
| PTK7 | VL | 5223 | SEQ ID NO. 68 in WO2012112943A1 |
| PTK7 | VL | 5224 | SEQ ID NO. 15 in US20150315293 |
| PTK7 | VL | 5225 | SEQ ID NO. 39 in US20150315293 |
| PTK7 | VL | 5226 | SEQ ID NO. 63 in US20150315293 |
| RAS | VL | 5227 | SEQ ID NO. 19 in WO2016154047 |
| RAS | VL | 5228 | SEQ ID NO. 49 in WO2016154047 |
| RAS | VL | 5229 | SEQ ID NO. 59 in WO2016154047 |
| RAS | VL | 5230 | SEQ ID NO. 69 in WO2016154047 |
| RAS | VL | 5231 | SEQ ID NO. 79 in WO2016154047 |
| RAS | VL | 5232 | SEQ ID NO. 9 in WO2016154047 |
| RHAMM antagonist body light chain | VL | 5233 | SEQ ID NO 4 in WO2000029447 |
| Rituximab | VL | 5234 | SEQ ID NO: 63 in US20160333114A1 |
| Rituximab | VL | 5235 | SEQ ID NO: 65 in US20160333114A1 |
| ROR1 | VL | 5236 | SEQ ID NO. 16 WO2016016343A1 |
| ROR1 | VL | 5237 | SEQ ID NO. 24 WO2016016343A1 |
| ROR1 | VL | 5238 | SEQ ID NO. 32 WO2016016343A1 |
| ROR1 | VL | 5239 | SEQ ID NO. 40 WO2016016343A1 |
| ROR1 | VL | 5240 | SEQ ID NO. 56 WO2016016343A1 |
| ROR1 | VL | 5241 | SEQ ID NO. 64 WO2016016343A1 |
| ROR1 | VL | 5242 | SEQ ID NO. 72 WO2016016343A1 |
| ROR1 | VL | 5243 | SEQ ID NO. 36 in WO2016016344A1 |
| ROR1 | VL | 5244 | SEQ ID NO. 62 in WO2016016344A1 |

TABLE 10-continued

Variable Heavy and Light Chain Sequences

| Target | Antibody chain | SEQ ID NO | Source |
|---|---|---|---|
| ROR1 | VL | 5245 | SEQ ID NO. 23 in WO2016016344A1 |
| ROR1 | VL | 5246 | SEQ ID NO. 49 in WO2016016344A1 |
| ROR1 | VL | 5247 | SEQ ID NO. 58 in WO2016016344A1 |
| ROR1 | VL | 5248 | SEQ ID NO. 86 in WO2016120216 |
| ROR1 | VL | 5249 | SEQ ID NO. 88 in WO2016120216 |
| ROR1 | VL | 5250 | SEQ ID NO. 90 in WO2016120216 |
| ROR1 | VL | 5251 | SEQ ID NO: 126 in US20160208018A1 |
| ROR1 | VL | 5252 | SEQ ID NO: 127 in US20160208018A1 |
| ROR1 | VL | 5253 | SEQ ID NO: 234 in US20160208018A1 |
| ROR1 | VL | 5254 | SEQ ID NO: 235 in US20160208018A1 |
| ROR1 | VL | 5255 | SEQ ID NO: 236 in US20160208018A1 |
| ROR1 | VL | 5256 | SEQ ID NO: 237 in US20160208018A1 |
| ROR1 | VL | 5257 | SEQ ID NO: 238 in US20160208018A1 |
| ROR1 | VL | 5258 | SEQ ID NO: 240 in US20160208018A1 |
| ROR1 | VL | 5259 | SEQ ID NO: 241 in US20160208018A1 |
| ROR1 | VL | 5260 | SEQ ID NO: 242 in US20160208018A1 |
| ROR1 | VL | 5261 | SEQ ID NO: 243 in US20160208018A1 |
| ROR1 | VL | 5262 | SEQ ID NO: 244 in US20160208018A1 |
| ROR1 | VL | 5263 | SEQ ID NO: 245 in US20160208018A1 |
| ROR1 | VL | 5264 | SEQ ID NO: 246 in US20160208018A1 |
| ROR1 | VL | 5265 | SEQ ID NO: 247 in US20160208018A1 |
| ROR1 | VL | 5266 | SEQ ID NO: 248 in US20160208018A1 |
| ROR1 | VL | 5267 | SEQ ID NO: 56 in EP3083671A1 |
| ROR1 | VL | 5268 | SEQ ID NO: 103 in WO2016187216A1 |
| ROR1 | VL | 5269 | SEQ ID NO: 111 in WO2016187216A1 |
| ROR1 | VL | 5270 | SEQ ID NO: 127 in WO2016187216A1 |
| ROR1 | VL | 5271 | SEQ ID NO: 135 in WO2016187216A1 |
| ROR1 | VL | 5272 | SEQ ID NO: 143 in WO2016187216A1 |
| ROR1 | VL | 5273 | SEQ ID NO: 15 in WO2016187216A1 |
| ROR1 | VL | 5274 | SEQ ID NO: 151 in WO2016187216A1 |
| ROR1 | VL | 5275 | SEQ ID NO: 159 in WO2016187216A1 |
| ROR1 | VL | 5276 | SEQ ID NO: 167 in WO2016187216A1 |
| ROR1 | VL | 5277 | SEQ ID NO: 175 in WO2016187216A1 |
| ROR1 | VL | 5278 | SEQ ID NO: 183 in WO2016187216A1 |
| ROR1 | VL | 5279 | SEQ ID NO: 191 in WO2016187216A1 |
| ROR1 | VL | 5280 | SEQ ID NO: 199 in WO2016187216A1 |
| ROR1 | VL | 5281 | SEQ ID NO: 207 in WO2016187216A1 |
| ROR1 | VL | 5282 | SEQ ID NO: 215 in WO2016187216A1 |
| ROR1 | VL | 5283 | SEQ ID NO: 223 in WO2016187216A1 |
| ROR1 | VL | 5284 | SEQ ID NO: 23 in WO2016187216A1 |
| ROR1 | VL | 5285 | SEQ ID NO: 231 in WO2016187216A1 |
| ROR1 | VL | 5286 | SEQ ID NO: 239 in WO2016187216A1 |
| ROR1 | VL | 5287 | SEQ ID NO: 247 in WO2016187216A1 |
| ROR1 | VL | 5288 | SEQ ID NO: 255 in WO2016187216A1 |
| ROR1 | VL | 5289 | SEQ ID NO: 263 in WO2016187216A1 |
| ROR1 | VL | 5290 | SEQ ID NO: 271 in WO2016187216A1 |
| ROR1 | VL | 5291 | SEQ ID NO: 279 in WO2016187216A1 |
| ROR1 | VL | 5292 | SEQ ID NO: 287 in WO2016187216A1 |
| ROR1 | VL | 5293 | SEQ ID NO: 295 in WO2016187216A1 |
| ROR1 | VL | 5294 | SEQ ID NO: 303 in WO2016187216A1 |
| ROR1 | VL | 5295 | SEQ ID NO: 31 in WO2016187216A1 |
| ROR1 | VL | 5296 | SEQ ID NO: 311 in WO2016187216A1 |
| ROR1 | VL | 5297 | SEQ ID NO: 319 in WO2016187216A1 |
| ROR1 | VL | 5298 | SEQ ID NO: 327 in WO2016187216A1 |
| ROR1 | VL | 5299 | SEQ ID NO: 335 in WO2016187216A1 |
| ROR1 | VL | 5300 | SEQ ID NO: 343 in WO2016187216A1 |
| ROR1 | VL | 5301 | SEQ ID NO: 351 in WO2016187216A1 |
| ROR1 | VL | 5302 | SEQ ID NO: 359 in WO2016187216A1 |
| ROR1 | VL | 5303 | SEQ ID NO: 39 in WO2016187216A1 |
| ROR1 | VL | 5304 | SEQ ID NO: 47 in WO2016187216A1 |
| ROR1 | VL | 5305 | SEQ ID NO: 55 in WO2016187216A1 |
| ROR1 | VL | 5306 | SEQ ID NO: 63 in WO2016187216A1 |
| ROR1 | VL | 5307 | SEQ ID NO: 7 in WO2016187216A1 |
| ROR1 | VL | 5308 | SEQ ID NO: 71 in WO2016187216A1 |
| ROR1 | VL | 5309 | SEQ ID NO: 79 in WO2016187216A1 |
| ROR1 | VL | 5310 | SEQ ID NO: 87 in WO2016187216A1 |
| ROR1 | VL | 5311 | SEQ ID NO: 95 in WO2016187216A1 |
| SEMAPHORIN4D | VL | 5312 | SEQ ID NO. 17 in US20160115240A1 |
| SEMAPHORIN4D | VL | 5313 | SEQ ID NO. 18 in US20160115240A1 |
| SEMAPHORIN4D | VL | 5314 | SEQ ID NO. 29 in US20160115240A1 |
| TAG73 | VL | 5315 | SEQ ID NO: 116 in US20160333114A1 |
| TCR | VL | 5316 | SEQ ID NO: 132 in WO2016122701 |
| TEM8 | VL | 5317 | SEQ ID NO: 4 in US20160264662A1 |
| TEM8 | VL | 5318 | SEQ ID NO: 6 in US20160264662A1 |
| TEM8 | VL | 5319 | SEQ ID NO: 8 in US20160264662A1 |

TABLE 10-continued

Variable Heavy and Light Chain Sequences

| Target | Antibody chain | SEQ ID NO | Source |
|---|---|---|---|
| Tie | VL | 5320 | SEQ ID NO 724 in US20060057138A1 |
| TIGIT | VL | 5321 | SEQ ID NO. 130 in US20160355589 |
| TIGIT | VL | 5322 | SEQ ID NO. 131 in US20160355589 |
| TIGIT | VL | 5323 | SEQ ID NO. 132 in US20160355589 |
| TIGIT | VL | 5324 | SEQ ID NO. 133 in US20160355589 |
| TIGIT | VL | 5325 | SEQ ID NO. 137 in US20160355589 |
| TIGIT | VL | 5326 | SEQ ID NO. 139 in US20160355589 |
| TIGIT | VL | 5327 | SEQ ID NO. 145 in US20160355589 |
| TIGIT | VL | 5328 | SEQ ID NO. 146 in US20160355589 |
| TIGIT | VL | 5329 | SEQ ID NO. 151 in US20160355589 |
| TIGIT | VL | 5330 | SEQ ID NO. 152 in US20160355589 |
| TIGIT | VL | 5331 | SEQ ID NO. 25 in US20160355589 |
| TIGIT | VL | 5332 | SEQ ID NO. 26 in US20160355589 |
| TIGIT | VL | 5333 | SEQ ID NO. 27 in US20160355589 |
| TIGIT | VL | 5334 | SEQ ID NO. 28 in US20160355589 |
| TIGIT | VL | 5335 | SEQ ID NO. 29 in US20160355589 |
| TIGIT | VL | 5336 | SEQ ID NO. 30 in US20160355589 |
| TIGIT | VL | 5337 | SEQ ID NO. 50 in US20160355589 |
| TIGIT | VL | 5338 | SEQ ID NO. 51 in US20160355589 |
| TIGIT | VL | 5339 | SEQ ID NO. 52 in US20160355589 |
| TIGIT | VL | 5340 | SEQ ID NO. 64 in US20160355589 |
| TIGIT | VL | 5341 | SEQ ID NO. 95 in US20160355589 |
| TIGIT | VL | 5342 | SEQ ID NO. 8 in US20160355589 |
| TIM3 | VL | 5343 | SEQ ID NO: 7 in WO2013006490 |
| TIM3 | VL | 5344 | SEQ ID NO. 107 in US20150086574 |
| TIM3 | VL | 5345 | SEQ ID NO. 117 in US20150086574 |
| TIM3 | VL | 5346 | SEQ ID NO. 17 in US20150086574 |
| TIM3 | VL | 5347 | SEQ ID NO. 27 in US20150086574 |
| TIM3 | VL | 5348 | SEQ ID NO. 37 in US20150086574 |
| TIM3 | VL | 5349 | SEQ ID NO. 47 in US20150086574 |
| TIM3 | VL | 5350 | SEQ ID NO. 57 in US20150086574 |
| TIM3 | VL | 5351 | SEQ ID NO. 67 in US20150086574 |
| TIM3 | VL | 5352 | SEQ ID NO. 7 in US20150086574 |
| TIM3 | VL | 5353 | SEQ ID NO. 77 in US20150086574 |
| TIM3 | VL | 5354 | SEQ ID NO. 87 in US20150086574 |
| TIM3 | VL | 5355 | SEQ ID NO. 97 in US20150086574 |
| TIM3 | VL | 5356 | SEQ ID NO: 17 in WO2016179319A1 |
| TIM3 | VL | 5357 | SEQ ID NO: 25 in WO2016179319A1 |
| TIM3 | VL | 5358 | SEQ ID NO: 33 in WO2016179319A1 |
| TIM3 | VL | 5359 | SEQ ID NO: 41 in WO2016179319A1 |
| TIM3 | VL | 5360 | SEQ ID NO: 49 in WO2016179319A1 |
| TIM3 | VL | 5361 | SEQ ID NO: 57 in WO2016179319A1 |
| TIM3 | VL | 5362 | SEQ ID NO: 65 in WO2016179319A1 |
| TIM3 | VL | 5363 | SEQ ID NO: 73 in WO2016179319A1 |
| TIM3 | VL | 5364 | SEQ ID NO: 81 in WO2016179319A1 |
| TIM3 | VL | 5365 | SEQ ID NO: 89 in WO2016179319A1 |
| TIM3 | VL | 5366 | SEQ ID NO: 9 in WO2016179319A1 |
| TIM3 | VL | 5367 | SEQ ID NO: 97 in WO2016179319A1 |
| Tissue factor | VL | 5368 | SEQ ID NO 25 in US20040229301A1 |
| Tissue factor | VL | 5369 | SEQ ID NO 31 in US20040229301A1 |
| Tissue factor | VL | 5370 | SEQ ID NO 12 in WO2004094475 |
| Tissue factor | VL | 5371 | SEQ ID NO 21 in WO2004094475 |
| Tissue factor | VL | 5372 | SEQ ID NO 25 in WO2004094475 |
| Tissue factor | VL | 5373 | SEQ ID NO 31 in WO2004094475 |
| Tissue factor | VL | 5374 | SEQ ID NO 8 in WO2004094475 |
| Tissue factor | VL | 5375 | SEQ ID NO: 35 in US20160333114A1 |
| Tissue factor | VL | 5376 | SEQ ID NO: 37 in US20160333114A1 |
| TRBC1 | VL | 5377 | SEQ ID NO. 2 in WO2015132598 |
| TrophoblastGlycoprotein5T4 | VL | 5378 | SEQ ID NO. 18 in WO2016034666A1 |
| TrophoblastGlycoprotein5T4 VL | VL | 5379 | SEQ ID NO. 12 in WO2016034666A1 |
| TrophoblastGlycoprotein5T4 VL | VL | 5380 | SEQ ID NO. 14 in WO2016034666A1 |
| TrophoblastGlycoprotein5T4 VL | VL | 5381 | SEQ ID NO. 16 in WO2016034666A1 |
| uPAR | VL | 5382 | SEQ ID NO: 71 in US20160333114A1 |
| uPAR | VL | 5383 | SEQ ID NO: 73 in US20160333114A1 |
| VEGF | VL | 5384 | SEQ ID NO 2 in WO2000034337 |
| VEGF | VL | 5385 | SEQ ID NO 6 in WO2000034337 |
| VEGF | VL | 5386 | SEQ ID NO. 9 in US20030175276A1 |
| VEGF | VL | 5387 | SEQ ID NO 11 in WO2006012688A1 |
| VEGF | VL | 5388 | SEQ ID NO 19 in WO2006012688A1 |
| VEGF | VL | 5389 | SEQ ID NO 27 in WO2006012688A1 |
| VEGF | VL | 5390 | SEQ ID NO 28 in WO2006012688A1 |
| VEGF | VL | 5391 | SEQ ID NO 3 in WO2006012688A1 |

TABLE 10-continued

Variable Heavy and Light Chain Sequences

| Target | Antibody chain | SEQ ID NO | Source |
|---|---|---|---|
| VEGF | VL | 5392 | SEQ ID NO 43 in WO2006012688A1 |
| VEGF | VL | 5393 | US20160090427 SEQ ID NO: 160 |
| VEGF | VL | 5394 | US20160090427 SEQ ID NO: 161 |
| VEGF | VL | 5395 | US20160090427 SEQ ID NO: 162 |
| VEGF | VL | 5396 | US20160090427 SEQ ID NO: 163 |
| VEGF | VL | 5397 | US20160090427 SEQ ID NO: 164 |
| VEGF | VL | 5398 | US20160090427 SEQ ID NO: 165 |
| VEGF | VL | 5399 | US20160090427 SEQ ID NO: 166 |
| VEGF | VL | 5400 | US20160090427 SEQ ID NO: 167 |
| VEGFR2 | VL | 5401 | SEQ ID NO. 107 in WO2017004254 |
| VEGFR2 | VL | 5402 | SEQ ID NO. 108 in WO2017004254 |
| VEGFR2 | VL | 5403 | SEQ ID NO. 109 in WO2017004254 |
| VEGFR2 | VL | 5404 | SEQ ID NO. 110 in WO2017004254 |
| VEGFR2 | VL | 5405 | SEQ ID NO. 111 in WO2017004254 |
| VEGFR2 | VL | 5406 | SEQ ID NO. 112 in WO2017004254 |
| VEGFR2 | VL | 5407 | SEQ ID NO. 113 in WO2017004254 |
| VEGFR2 | VL | 5408 | SEQ ID NO. 86 In WO2017004254 |
| VEGFR2 | VL | 5409 | SEQ ID NO. 87 In WO2017004254 |
| VEGFR2 | VL | 5410 | SEQ ID NO. 88 In WO2017004254 |
| VEGFR2 | VL | 5411 | SEQ ID NO. 89 In WO2017004254 |
| VEGFR2 | VL | 5412 | SEQ ID NO. 90 In WO2017004254 |
| VEGFR2 | VL | 5413 | SEQ ID NO. 91 In WO2017004254 |
| VEGFR2 | VL | 5414 | SEQ ID NO. 92 In WO2017004254 |
| VEGFR2 | VL | 5415 | SEQ ID NO. 93 In WO2017004254 |
| VEGFR2 | VL | 5416 | SEQ ID NO. 94 In WO2017004254 |
| VISTA | VL | 5417 | SEQ ID NO: 41 in WO2015097536 |
| VISTA | VL | 5418 | SEQ ID NO: 42 in WO2015097536 |
| VISTA | VL | 5419 | SEQ ID NO: 43 in WO2015097536 |
| VISTA | VL | 5420 | SEQ ID NO: 44 in WO2015097536 |
| VISTA | VL | 5421 | SEQ ID NO: 45 in WO2015097536 |
| VMS2 | VL | 5422 | FIG. 2 in WO2000058363 |
| WT1/HLA Bi Specific | VL | 5423 | SEQ ID NO. 106 in WO2015070061 |
| WT1/HLA Bi Specific | VL | 5424 | SEQ ID NO. 112 in WO2015070061 |
| WT1/HLA Bi Specific | VL | 5425 | SEQ ID NO. 130 in WO2015070061 |
| WT1/HLA Bi Specific | VL | 5426 | SEQ ID NO. 34 in WO2015070061 |
| WT1/HLA Bi Specific | VL | 5427 | SEQ ID NO. 52 in WO2015070061 |
| WT1/HLA Bi Specific | VL | 5428 | SEQ ID NO. 70 in WO2015070061 |
| WT1/HLA Bi Specific | VL | 5429 | SEQ ID NO. 88 in WO2015070061 |
| 5T4 | VL | 5430 | SEQ ID NO. 1 in WO2016022939 |
| 5T4 | VL | 5431 | SEQ ID NO. 3 in WO2016022939 |
| ALK | VL | 5432 | SEQ ID NO. 10 in WO2015069922 |
| ALK | VL | 5433 | SEQ ID NO. 12 in WO2015069922 |
| ALK | VL | 5434 | SEQ ID NO. 14 in WO2015069922 |
| ALK | VL | 5435 | SEQ ID NO. 16 in WO2015069922 |
| ALK | VL | 5436 | SEQ ID NO. 8 in WO2015069922 |
| ALKVL | VL | 5437 | SEQ ID NO. 2 in WO2015069922 |
| ALKVL | VL | 5438 | SEQ ID NO. 4 in WO2015069922 |
| ALKVL | VL | 5439 | SEQ ID NO. 6 in WO2015069922 |
| CD123 | VL | 5440 | SEQ ID NO. 114 in WO2016120216 |
| CD123 | VL | 5441 | SEQ ID NO. 116 in WO2016120216 |
| CD123 | VL | 5442 | SEQ ID NO. 58 in WO2016120216 |
| CD123 | VL | 5443 | SEQ ID NO. 60 in WO2016120216 |
| CD123 | VL | 5444 | SEQ ID NO. 64 in WO2016120216 |
| CD16 | VL | 5445 | SEQ ID NO. 26 in WO2015158868 |
| CD22 | VL | 5446 | SEQ ID NO. 1 in WO2013059593 |
| CD276 | VL | 5447 | SEQ ID NO. 18 in US20160053017 |
| CD276 | VL | 5448 | SEQ ID NO. 27 in US20160053017 |
| CD28 | VL | 5449 | SEQ ID NO. 20 in WO2015158868 |
| CD73 | VL | 5450 | SEQ ID NO. 101 in US20160145350 |
| CD73 | VL | 5451 | SEQ ID NO. 102 in US20160145350 |
| CD73 | VL | 5452 | SEQ ID NO. 104 in US20160145350 |
| CD73 | VL | 5453 | SEQ ID NO. 106 in US20160145350 |
| CD73 | VL | 5454 | SEQ ID NO. 110 in US20160145350 |
| CD73 | VL | 5455 | SEQ ID NO. 117 in US20160145350 |
| CD73 | VL | 5456 | SEQ ID NO. 118 in US20160145350 |
| CD73 | VL | 5457 | SEQ ID NO. 120 in US20160145350 |
| CD73 | VL | 5458 | SEQ ID NO. 122 in US20160145350 |
| CD74 | VL | 5459 | SEQ ID NO. 25 in US20130171064 |
| CD74 | VL | 5460 | SEQ ID NO. 29 in US20130171064 |
| CD74 | VL | 5461 | SEQ ID NO. 31 in US20130171064 |
| CD74 | VL | 5462 | SEQ ID NO. 35 in US20130171064 |
| CS1 | VL | 5463 | SEQ ID NO. 110 in WO2016120216 |
| CS1 | VL | 5464 | SEQ ID NO. 112 in WO2016120216 |
| CSPG4 | VL | 5465 | SEQ ID NO. 12 in WO2016077638 |
| CSPG4 | VL | 5466 | SEQ ID NO. 14 in WO2016077638 |

TABLE 10-continued

Variable Heavy and Light Chain Sequences

| Target | Antibody chain | SEQ ID NO | Source |
|---|---|---|---|
| EGFRvIII | VL | 5467 | SEQ ID NO. 92 in WO2016120216 |
| EGFRvIII | VL | 5468 | SEQ ID NO. 94 in WO2016120216 |
| ERBB2 | VL | 5469 | US20110129464 SEQ ID NO: 3 |
| GPC3 | VL | 5470 | SEQ ID NO. 23 in WO2016049459 |
| Malignant Variable Receptor | VL | 5471 | SEQ ID NO. 5 in WO2015133817A1 |
| OX40 | VL | 5472 | SEQ ID NO. 29 in US20160137740 |
| OX40 | VL | 5473 | SEQ ID NO. 37 in US20150190506 |

Intrabodies

In some embodiments, payloads of the present invention may be intrabodies against players in regulating immune cells. An intrabody is an antibody that is designed to be expressed intracellularly and can be directed to a specific target antigen present in various subcellular locations including the cytosol, nucleus, endoplasmic reticulum (ER), mitochondria, peroxisomes, plasma membrane and trans-Golgi network (TGN) through in frame fusion with intracellular trafficking/localization peptide sequences. The most commonly used format is a single chain antibody (scFv) created by joining the antigen-binding variable domains of heavy and light chain with a linker, most often the 15-amino acid linker (e.g., (GGGGS)$_3$ (SEQ ID NO: 307)) between the variable heavy (VH) and variable light (VL) chains. The intracellular intrabodies are being developed to bind to, neutralize, or modify the function or localization of cancer-related targets and thereby affect the malignant phenotype.

Players that modulate immune cells (e.g., T cells) may be any intracellular signaling checkpoint. Exemplary players may include a co-inhibitory ligand, Casitas B-linage lymphoma proto-oncogene-b (Cbl-b) (a E3 ligase), a protein tyrosine phosphatase (PTP) such as Src homology 2 domain-containing protein tyrosine phosphatase 1 (SHP-1), and Ras. For example, an intrabody may be an intrabody against oncogenic form of RAS disclosed in PCT patent publication NO.: WO2004/046186; the contents of which are incorporated by reference in their entirety.

Therapeutic Antibodies

In some embodiments, antibody payloads of the present invention may be therapeutic antibodies. As non-limiting examples, antibodies and fragments and variants thereof may be specific to tumor associated antigens, or tumor specific antigens, or pathogen antigens. In some aspects, antibodies may be blocking antibodies (also referred to as antagonistic antibodies), for example, blocking antibodies against PD-1, PD-L1, PD-L2, CTLA-4 and other inhibitory molecules. In other aspects, antibodies may be agonist antibodies such as agonistic antibodies specific to stimulatory molecules, e g., 4-1BB (CD137), OX40 (CD134), CD40, GITR and CD27.

Other exemplary therapeutic antibodies may include, but are not limited to, Abagovomab, Abcxmab, Abituzumab, Abrilumab, Actoxumab, Adalimumab, Adecatumumab, Afasevikumab, Afelimomab, Afutuzumab, Alacizumab, Alemtuzumab, Alirocumab, Altumomab, Amatuximab, Anetumab, Anifrolumab, Apolizumab, Arcitumomab, Ascrinvacumab, Aselizumab, Atezolizumab, Atinumab, Atlizumab, Atorolimumab, Avelumab, Bapineuzumab, Basiliximab, Bavituximab, Bectumomab, Begelomab, Belimumab, Benralizumab, Bertilimumab, Besilesomab, Bevacizumab, Bezlotoxumab, Biciromab, Bimagrumab, Bimekizumab, Bivatuzumab, Bleselumab, Blinatumomab, Blinatumomab, Blosozumab, Bococizumab, Brentuximab, Briaknumab, Brodalumab, Brolucizumab, Brontictuzumab, Cabiralizumab, Canakinumab, Cantuzumab, Caplacizumab, Capromab, Carlumab, Carotuximab, Catumaxomab, cBR96-doxorubicin immunoconjugate, Cedelizumab, Cergutuzumab, Certolizumab pegol, Cetuximab, Citatuzumab, Cixutumumab, Clazakizumab, Clenoliximab, Clivatuzumab, Codrituzumab, Coltuximab, Contatumumab, Concizumab, Crenezumab, Crotedumab, CR6261, Dacetumab, Daclizumab, Dalotuzumab, Dapirolizumab pegol, Daratumumab, Dectrekumab, Demcizumab, Denintuzumab, Denosumab, Derlotuximab biotin, Detumomab, Dinutuximab, Diridavumab, Domagrozumab, Dorlimomab aritox, Drozitumab, Duligotumab, Dupilumab, Durvalumab, Dusigitumab, Ecromeximab, Eculizumab, Edobacomab, Edrecolomab, Efalizumab, Efungumab, Eldelumab, Elgemtumab, Elotuzumab, Elsilimomab, Emactuzumab, Emibetuzumab, Emicizumab, Enavatuzumab, Enfortumab vedotin, Enlimomab pegol, Enoblituzumab, Enokizumab, Enoticumab, Ensituximab, Epitumomab cituxetan, Epratuzumab, Erlizumab, Ertumaxomab, Etaracizumab, Etrolizumab, Evinacumab, Evolocumab, Exbivirumab, Fanolesomab, Faralimomab, Farletuzumab, Fasinumab, FBTA05, Felvizumab, Fezakinumab, Fibatuzumab, Ficlatuzumab, Figitumumab, Firivumab, Flanvotumab, Fletikumab, Fontolizumab, Foralumab, Foravirumab, Fresolimumab, Fulranumab, Futuximab, Galcanezumab, Galiximab, Ganitumab, Gantenerumab, Gavilimomab, Gemtuzumab ozogamicin, Gevokizumab, Girentuximab, Glembatumumab vedotin, Golimumab, Gomiliximab, Guselkumab, Ibalizumab, Ibritumomab tiuxetan, icrucumab, Idarucizumab, Igovomab, IMAB362, Imalumab, Imciromab, Imgatuzumab, Inclacumab, Indatuximab, Indusatumab, Inebilizumab, Infliximab, Intetumumab, Inolimomab, Inotuzumab, Ipilimumab, Iratumumab, Isatuximab, Itolizumab, Ixekizumab, Keliximab, Labetuzumab, Lambrolizumab, Lampalizumab, Lanadelumab, Landogrozumab, Lapritixumab, Lebrikizumab, Lemalesomab, Lendalizumab, Lenzilumab, Lerdelimumab, Lexatumumab, Libivirumab, Lifastuzumab, Ligelizumab, Lilotomab, Lintuzumab, Lirilumab, Lodelcizumab, Lokivetmab, Lorvotuzumab, Lucatumumab, Lulizumab pegol, Lumiliximab, Lumretuzumab, Mapatumumab, Margetuximab, Maslimomab, Mavrilimumab, Matuzumab, Mepolizumab, Metelimumab, Milatuzumab, Minretumomab, Mirvetuximab, Mitumomab, Mogamulizumab, Monalizumab, Morolimumab, Motavizumab, Moxetumomab pasudotox, Muromonab-CD3, nacolomab tafenatox, Namilumab, naptumomab, naratuximab, Narnatumab, Natalizumab, Navicixizumab, Navivumab, Nebacumab, Necitumumab, Nemolizumab, Nerelimomab, Nesvacumab, Nimotuzumab, Nivolumab, Nofetumomab, Obiltoxaximab, Obinutuzumab, Ocaratuzumab, Ocrelizumab, Odulimomab, Ofatumumab, Olaratumab, Olaratumab, Olokizumab, Omalizumab, Onartuzumab, Ontuxizumab, Opicinumab, Oportuzumab monatox, Oregovomab, Orticumab, Otelixizumab, Otlertuzumab, Oxelumab, Ozanezumab, Ozoralizumab, Pagibaximab, Palivizumab, Pamrevlumab, Panitumumab, Pankomab, Panobacumab, Parsatuzumab, Pascolizumab, Pasotuxizumab, Pateclizumab, Patritumab, Pembrolizumab, Pemtumomab, Perakizumab, Pertuzumab, Pexelizumab, Pidilizumab, Pinatuzumab, Pintumomab, Placulumab, Plozalizumab, Pogalizumab, Polatuzumab, Ponezumab, Prezalizumab, Priliximab, Pritoxaximab, Pritumumab, PRO 140, Quilizumab, Racotumomab, Radretumab, Rafivirumab, Ralpancizumab, Ramucirumab, Ranibizumab, Raxibacumab, Refanezumab, Regavirumab, Reslizumab, Rilotumumab, Rinucumab, Risankizumab, Rituximab, Rivabazumab pegol, Robatumumab, Roledumab, Romosozumab, Rontalizumab, Rovalpituzumab, Rovelizumab, Ruplizumab, Sacituzumab, Samalizumab, Sapelizumab, Sarilumab, Satumomab pendetide, Secukinumab, Seribantumab, Setoxaximab, Sevirumab, Sibrotuzumab, SGN-CD19A, SGN-CD33A, Sifalimumab, Siltuximab, Simtuzumab, Siplizumab, Sirukumab, Sofituzumab vedotin, Solanezumab, Solitomab, Sonepcizumab, Sontuzumab, Stamulumab, Sulesomab, Suvizumab, tabalumab, Tacatuzumab, Tadocizumab, Talizumab, Tamtuvetmab, Tanezumab, Taplitumomab, Tarextumab, Tefibazumab, Telimomab aritox, Tenatumomab, Teneliximab, Teplizumab, Teprotumumab, Tesidolumab, Tetulomab, Tezepelumab, TGN1412, Ticilimumab, Tildrakizumab, Tigatuzumab, Timolumab, Tisotumab vedotin, TNX-650, Tocilizumab, Toralizumab, Tosatoxumab, Tositumomab, Tovetumab, Tralokinumab, Trastuzumab, TRBS07, Tregalizumab, Tremelimumab, Trevogrumab, Tucotuzumab, Tuvirumab, Ublituximab, Ulcocuplumab, Urelumab, Urtoxazumab, Ustekinumab, Vadastuximab talirine, Vandortuzumab vedotin, Vantictumab, Vanucizumab, Vapaliximab, Varlilumab, Vatelizumab, Vedolizumab, Veltuzumab, Vepalimomab, Vesencumab, Visilizumab, Vobarilizumab, Volociximab, Vorsetuzumab, Votumumab, Xentuzumab, Zalutumumab, Zanolimumab, Zatuximab, Ziralimumab and Zolimomab aritox.

Bicistronic and/or Pseudo-Bicistronic Antibody Payloads

According to the present invention, a bicistronic payload is a polynucleotide encoding a two-protein chain antibody on a single polynucleotide strand. A pseudo-bicistronic payload is a polynucleotide encoding a single chain antibody discontinuously on a single polynucleotide strand. For bicistronic payloads, the encoded two strands or two portions/regions and/or domains (as is the case with pseudo-bicistronic) are separated by at least one nucleotide not encoding the strands or domains. More often the separation comprises a cleavage signal or site or a non-coding region of nucleotides. Such cleavage sites include, for example, furin cleavage sites encoded as an "RKR" site, or a modified furin cleavage site in the resultant polypeptide or any of those taught herein.

According to the present invention, a single domain payload comprises one or two polynucleotides encoding a single monomeric variable antibody domain. Typically, single domain antibodies comprise one variable domain (VH) of a heavy-chain antibody.

According to the present invention, a single chain Fv payloads is a polynucleotide encoding at least two coding regions and a linker region. The scFv payload may encode a fusion protein of the variable regions of the heavy (VH) and light chains (VL) of immunoglobulins, connected with a short linker peptide of ten to about 25 amino acids. The linker is usually rich in glycine for flexibility, as well as serine or threonine for solubility, and can either connect the N-terminus of the VH with the C-terminus of the VL, or vice versa. Other linkers include those known in the art and disclosed herein.

According to the present invention, a bispecific payload is a polynucleotide encoding portions or regions of two different antibodies. Bispecific payloads encode polypeptides which may bind two different antigens. Polynucleotides of the present invention may also encode trispecific antibodies having an affinity for three antigens.

3. Tumor and Pathogen Specific Antigens

In some embodiments, payloads of the present invention may be tumor specific antigens (TSAs), tumor associated antigens (TAAs), pathogen associated antigens, or fragments thereof. The antigen can be expressed as a peptide or as an intact protein or portion thereof. The intact protein or a portion thereof can be native or mutagenized. Antigens associated with cancers or virus-induced cancers as described herein are well-known in the art. Such a TSA or TAA may be previously associated with a cancer or may be identified by any method known in the art.

A tumor specific antigen (TSA) may be a tumor neoantigen. A neoantigen is a mutated antigen that is only expressed by tumor cells because of genetic mutations or alterations in transcription which alter protein coding sequences, therefore creating novel, foreign antigens. The genetic changes result from genetic substitution, insertion, deletion or any other genetic changes of a native cognate protein (i.e. a molecule that is expressed in normal cells).

As non-limiting examples, neoantigens may include mutated new peptides derived from alpha-actinin-4, ARTC1, BCR-ABL fusion protein (b3a2), B-RAF, CASP-5, CASP-8, beta-catenin, Cdc27, CDK4, CDKN2A, CLPP, CML-66, COA-1, connexin 37, dek-can fusion protein, EFTUD2, Elongation factor 2, ETV6-AML1 fusion protein, fibronectin, FLT3-ITD, FN1, GPNM8, LDLR-fucosyltransferase AS fusion protein, HLA-A2, HLA-A11, Hsp-70-1B, MART-2, ME1, MUM-1, MUM-2, MUM-3, Myosin class I, NFYC, neo-PAP, OGT, OS-9, p53, pml-RARalpha fusion protein, PRDX5, PTPRK, K-Ras, N-Ras, RBAF600, sirtuin-2, SNRPD1, SYT-SSX1/SSX2 fusion protein, TGF-beta receptor II, etc. Additional neoantigen peptides may include SF3B1 peptides, MYD peptides, TP53 peptides, Abl peptides, FBXW7 peptides, MAPK peptides, and GNB1 peptides disclosed in US patent publication NO.: 20110293637; the contents of which are incorporated herein by reference in their entirety.

New neoantigens identified through large-scale sequencing and algorithm calculation may also be included. See, e.g., International Patent Publication NO.: WO2014/168874; Nishimura et al., *Cancer Sci.* 2015, 106(5): 505-511; and Linnemann et al., *Nat. Med.,* 2015, 21(1): 81-85; the contents of each of which are incorporated herein by reference in their entirety.

A tumor associated antigen (TAA) may be an overexpressed or accumulated antigen that is expressed by both normal and neoplastic tissue, with the level of expression highly elevated in cancer tissues. Numerous proteins (e.g. oncogenes) are up-regulated in tumor tissues, including but not limited to adipophilin, AIM-2, ALDH1A1, BCLX(L), BING-4, CALCA, CD45, CD274, CPSF, cyclin D1, DKK1, ENAH, epCAM, ephA3, EZH2, FGF5, G250, HER-2/neu, HLA-DOB, Hepsin, IDO1, IGFB3, IL13Ralpha2, Intestinal carboxyl esterase, kallikrein 4, KIF20A, lengsin, M-CSF, MCSP, mdm-2, Meloe, Midkine, MMP-2, MMP-7, MUC-1, MUC5AC, p53, Pax5, PBF, PRAME, PSMA, RAGE-1, RGS5, RhoC, RNF43, RU2A5, SECERNIN 1, SOX10, STEAP1, survivin, Telomerase, TPBG, VEGF, and WT1.

A TAA may be an oncofetal antigen that is typically only expressed at different stages during the development of the fetus and in cancerous somatic cells. Many proteins are normally expressed during fetal development but are transcriptionally repressed after birth or at early stage of infancy, therefore are not present, or are expressed in significantly lower levels in the corresponding normal adult tissue. Some of these developmental proteins are re-expressed in certain tumor cells and become oncofetal antigens. Examples of oncofetal antigens may include, but are not limited to CEA (carcinoembryonic antigen) in colorectal carcinoma, iLRP/OFA (immature laminin receptor protein/oncofetal antigen) in renal cell carcinoma (RCC), TAG-72 (tumor associated glycoprotein-72) in prostate carcinoma, AFP (alpha-fetoprotein) in hepatocellular carcinoma (HCC), ROR1 (a receptor tyrosine kinase) in many malignant cells such as brain tumors, sperm protein 17, HMGA2 (high mobility group A2) in ovarian carcinoma, oncofetal H19, CR-1 (Cripto-1, a member of epidermal growth factor (EGF)-CFC family), trophoblast glycoprotein precursor and GPC-3 (Glypican-3, a member of heparan sulphate proteoglycans) in HCC.

A TAA may be a cancer-testis antigen that is expressed only by cancer cells and adult reproductive tissues such as testis and placenta, including, but limited to antigens from BAGE family, CAGE family, HAGE family, GAGE family, MAGE family (e.g., MAGE-A1, MAGE-A2, MAGE-A3, MAGE-A6 and MAGE-A13), SAGE family, XAGE family, MCAK, NA88-A (cancer/testis antigen 88), PSAD1, SSX-2, and SLLP-1.

A TAA may be a lineage restricted antigen that is expressed largely by a single cancer histotype, such as Melan-A/MART-1, Gp100/pmel17, Tyrosinase, TRP-1/-2, P. polypeptide, MC1R in melanoma; and prostate specific antigen (PSA) in prostate cancer.

A TAA may be an oncoviral antigen that is encoded by tumorigenic transforming viruses (also called oncogenic viruses). Oncogenic viruses, when they infect host cells, can insert their own DNA (or RNA) into that of the host cells. When the viral DNA or RNA affects the host cell's genes, it can push the cell toward becoming cancer. Oncogenic viruses include, but are not limited to, RNA viruses, and DNA viruses. Some examples of commonly known oncoviruses include human papilloma viruses (HPVs) which are main causes of cervical cancer, Epstein-Barr virus (EBV) which may cause nasopharyngeal cancer, certain types of fast-growing lymphomas (e.g., Burkitt lymphoma) and stomach cancer, hepatitis B, C and D viruses (HBV, HCV and HDV) in hepatocellular carcinoma (HCC), human immunodeficiency virus (HIV) which increases the risk of getting many types of cancer (e.g., liver cancer, anal cancer and Hodgkin cancer), Kaposi sarcoma herpes virus (KSHV; also known as human herpes virus 8 (HHV8)) which is linked to lymphoma, human T-lymphotrophic virus (HTLV-1) and merkel cell polymavirus (MCV). A viral antigen can be any defined antigen of a virus that is associated with a cancer in a human. For example, antigens from EBV may include but are not limited to, Epstein-Barr nuclear antigen-1 (EBNA1), latent membrane protein 1 (LMP1), or latent membrane protein 2 (LMP2).

A TAA may be an idiotypic antigen that is generated from highly polymorphic genes where a tumor cell expresses a specific "clonotype", i.e., as in B cell, T cell lymphoma/leukemia resulting from clonal aberrancies, such as Immunoglobulin and T cell receptors (TCRs). Idiotypic antigens are a class of non-pathogen-associated neoantigens. For example, the malignant B cells express rearranged and multiply mutated surface immunoglobulins (Ig). Tumor specific idiotypes (e.g., immunoglobulin idiotypes) are regarded as particularly attractive tumor-specific antigens that can be successfully targeted by immunotherapy (e.g., Alejandro et al., Front Oncol., 2012, 2: 159).

4. T Cell Receptors (TCRs)

In some embodiments, payloads of the present invention may be T cell receptors (TCRs). The TCR may be specific to a cancer antigen, having a specific α chain and β chain which together form a TCRαβ heterodimer, or having a specific γ chain and δ chain which together form a TCRγδ heterodimer. The TCR may be a recombinant antigen specific T cell receptor.

The variable regions of α chain and β chain determine T cell specificity to an antigenic peptide presented by the major histocompatibility complex (MHC) class I and II molecules. The TCR recognition of the tumor antigen on the surface of a tumor cell presented by MHC molecules by TCR triggers T cell activation. The use of TCR gene therapy can equip a subject's own T cells with desired specificities and generate sufficient numbers of T cells to eradicate tumor cells. In some embodiments, a biocircuit or an effector module comprising a tumor specific TCR may be transduced into T cells and TCR-engineered T cells will be infused into cancer patients who have lymphocytopenia or lymphopenia by chemotherapy or irradiation, allowing efficient engraftment but inhibiting immune suppression.

Sequences encoding tumor antigen recognizing TCR chains can be obtained from tumor-reactive T cells (e.g., tumor-infiltrating lymphocytes isolated from the tumor of a patient).

According to the present invention, a TCR specific to tumor cells can be produced by methods described in International Patent Publication NO.: WO2014/083173; the contents of which are incorporated herein by reference in their entirety. A host organism expressing a transgene of a human leucocyte antigen (HLA) type which is known or suspected to be able to present a mutated tumor specific antigen (TSA) is transduced to express the un-rearranged human TCR loci. Preferably these loci encode TCR α and β chains, and preferably comprise a plurality, ideally all, of human TCR V, D, J, and/or C genes. The host organism is immunized with a cancer specific TSA or a peptide epitope derived from the TSA and T cells expressing rearranged TCRs specifically against the TSA are isolated and cloned. The TCR from the cloned T cells are sequenced (International Patent Publication NO.: WO2014/083173; the contents of which are incorporated herein by reference in their entirety).

In some embodiments, payloads of the present invention may be TCRs that specifically recognize TSAs, TAAs, or epitopes thereof, complexed with MHC molecules.

Exemplary tumor antigens that can be recognized by a TCR may include at least the following: 5T4, 707-AP, A33, AFP (α-fetoprotein), AKAP-4 (A kinase anchor protein 4), ALK, α5β1-integrin, androgen receptor, annexin II, alpha-actinin-4, ART-4, B1, B7H3, B7H4, BAGE (B melanoma antigen), BCMA, BCR-ABL fusion protein, beta-catenin, BKT-antigen, BTAA, CA-I (carbonic anhydrase I), CA50 (cancer antigen 50), CA125, CA15-3, CA195, CA242, calretinin, CAIX (carbonic anhydrase), CAMEL (cytotoxic T-lymphocyte recognized antigen on melanoma), CAM43, CAP-1, Caspase-8/m, CD4, CD5, CD7, CD19, CD20, CD22, CD23, CD25, CD27/m, CD28, CD30, CD33, CD34, CD36, CD38, CD40/CD154, CD41, CD44v6, CD44v7/8, CD45, CD49f, CD56, CD68KP1, CD74, CD79a/CD79b, CD103, CD123, CD133, CD138, CD171, cdc27/m, CDK4 (cyclin dependent kinase 4), CDKN2A, CDS, CEA (carcinoembryonic antigen), CEACAM5, CEACAM6, chromogranin, c-Met, c-Myc, coa-1, CSAp, CT7, CT10, cyclophilin B, cyclin B1, cytoplasmic tyrosine kinases, cytokeratin, DAM-10, DAM-6, dek-can fusion protein, desmin, DEPDC1 (DEP domain containing 1), E2A-PRL, EBNA, EGF-R (epidermal growth factor receptor), EGP-1 (epithelial glycoprotein-1) (TROP-2), EGP-2, EGP-40, EGFR (epidermal growth factor receptor), EGFRvIII, EF-2, ELF2M, EMMPRIN, EpCAM (epithelial cell adhesion molecule), EphA2, Epstein Barr virus antigens, Erb (ErbB1; ErbB3; ErbB4), ETA (epithelial tumor antigen), ETV6-AML1 fusion protein, FAP (fibroblast activation protein), FBP (folate-binding protein), FGF-5, folate receptor α, FOS related antigen 1, fucosyl GM1, G250, GAGE (GAGE-1; GAGE-2), galactin, GD2 (ganglioside), GD3, GFAP (glial fibrillary acidic protein), GM2 (oncofetal antigen-immunogenic-1; OFA-I-1), GnT-V, Gp100, H4-RET, HAGE (helicase antigen), HER-2/neu, HIFs (hypoxia inducible factors), HIF-1α, HIF-2α, HLA-A2, HLA-A*0201-R170I, HLA-A11, HMWMAA, Hom/Mel-40, HSP70-2M (Heat shock protein 70), HST-2, HTgp-175, hTERT (or hTRT), human papillomavirus-E6/human papillomavirus-E7 and E6, iCE (immune-capture EIA), IGF-1R, IGH-IGK, IL2R, IL5, ILK (integrin-linked kinase), IMP3 (insulin-like growth factor II mRNA-binding protein 3), IRF4 (interferon regulatory factor 4), KDR (kinase insert domain receptor), KIAA0205, KRAB-zinc finger protein (KID)-3; KID31, KSA (17-1A), K-ras, LAGE, LCK, LDLR/FUT (LDLR-fucosyltransferaseAS fusion protein), LeY (Lewis Y), MAD-CT-1, MAGE (tyrosinase, melanoma-associated antigen) (MAGE-1; MAGE-3), melan-A tumor antigen (MART), MART-2/Ski, MC1R (melanocortin 1 receptor), MDM2, mesothelin, MPHOSPH1, MSA (muscle-specific actin), mTOR (mammalian targets of rapamycin), MUC-1, MUC-2, MUM-1 (melanoma associated antigen (mutated) 1), MUM-2, MUM-3, Myosin/m, MYL-RAR, NA88-A, N-acetylglucosaminyltransferase, neo-PAP, NF-KB (nuclear factor-kappa B), neurofilament, NSE (neuron-specific enolase), Notch receptors, NuMa, N-Ras, NY-BR-1, NY-CO-1, NY-ESO-1, Oncostatin M, OS-9, OY-TES1, p53 mutants, p190 minor bcr-abl, p15(58), p185erbB2, p180erbB-3, PAGE (prostate associated gene), PAP (prostatic acid phosphatase), PAX3, PAX5, PDGFR (platelet derived growth factor receptor), cytochrome P450 involved in piperidine and pyrrolidine utilization (PIPA), Pml-RAR alpha fusion protein, PR-3 (proteinase 3), PSA (prostate specific antigen), PSM, PSMA (Prostate stem cell antigen), PRAME (preferentially expressed antigen of melanoma), PTPRK, RAGE (renal tumor antigen), Raf (A-Raf, B-Raf and C-Raf), Ras, receptor tyrosine kinases, RCAS 1, RGSS, ROR1 (receptor tyrosine kinase-like orphan receptor 1), RU1, RU2, SAGE, SART-1, SART-3, SCP-1, SDCCAGi6, SP-17 (sperm protein 17), src-family, SSX (synovial sarcoma X breakpoint)-1, SSX-2(HOM-MEL-40), SSX-3, SSX-4, SSX-5, STAT-3, STAT-5, STAT-6, STEAD, STn, survivin, syk-ZAP70, TA-90 (Mac-2 binding proteincyclophilin C-associated protein), TAAL6, TACSTD1 (tumor associated calcium signal transducer 1), TACSTD2, TAG-72-4, TAGE, TARP (T cell receptor gamma alternate reading frame protein), TEL/AML1 fusion protein, TEM1, TEM8 (endosialin or CD248), TGFβ, TIE2, TLP, TMPRSS2 ETS fusion gene, TNF-receptor (TNF-α receptor, TNF-β receptor; or TNF-γ receptor), transferrin receptor, TPS, TRP-1 (tyrosine related protein 1), TRP-2, TRP-2/INT2, TSP-180, VEGF receptor, WNT, WT-1 (Wilm's tumor antigen) and XAGE.

In one aspect, the payload of the present invention may be a TCR specifically recognizing Her2/neu epitope which has nucleic acid sequences of α chain and β chain disclosed in U.S. Patent Publication NO.: US20110280894 and International Patent Publication NO. WO2016133779A1; the contents of each of which are incorporated herein by reference in their entirety. In another aspect, the payload of the present invention may be a TCR specific to TSA tyrosinase (See U.S. Pat. No. 8,697,854; the contents of which are incorporated herein by reference in their entirety).

In other aspects, payloads of the present invention may be TCRs having polypeptide sequences specific to synovial sarcoma X Breakpoint (SSX)-2 antigen (U.S. Pat. No. 9,345,748); human papillomavirus (HPV) 16 E6 antigen (International Patent Publication NO.: WO2015/009606); cytomegalovirus (CMV) phosphoprotein pp65 (U.S. Pat. No. 8,722,048); and WT-1 specific TCR comprising a TCR α-chain having an amino acid sequence as set forth in any one of SEQ ID NOs.: 5-8, and comprising a TCR β-chain having an amino acid sequence as set forth in SEQ ID NO.: 12 or 13, as disclosed in US patent publication NO.: US2016/0083449; the contents of each of which are incorporated herein by reference in their entirety.

In some embodiments, the TCR specific to a TSA may be modified to possess a sequence encoding an affinity weakening motif which imparts a reduction in non-specific binding to a TSA. In some embodiments, an affinity weakening motif having a modification to a TCR CDR1 or CDR2 region may be used to weaken the interaction between TCR and HLA proteins (see, International Patent Publication NO.: WO2016/014725; the contents of which are incorporated herein by reference in their entirety).

In some embodiments, the TCR specific to a TSA may be modified to possess an affinity enhancing motif which imparts an enhancement of binding specificity and affinity for a target antigen. In some embodiments, such high affinity TCRs may be generated by using TCR α-chain to select de novo generated TCR β-chains that pair with an antigen specific TCR α-chain during T cell development in vitro to form enhanced TCRs (see, International Patent Publication NO.: WO2013/166321; the contents of which are incorporated herein by reference in their entirety). In other embodiments, the modified TCR may also possess a sequence encoding an affinity enhancing modification CDR3 region which strengthens the interaction between the TCR and the TSA.

In one embodiment, the TCR specific to a TSA may be modified using zinc finger nucleases (ZFNs), TALENs or a CRISPR/Cas system. The TCR α chain and β chain may contain target sites of a nuclease. The nuclease can cleave the TCR sequence causing a certain degree of disruption of the TCR (see US Patent Publication NO.: US2014/0301990; the contents of which are incorporated herein by reference in their entirety).

In one embodiment, the TCR specific to a TSA may be a soluble single-chain TCR having the structure: Vα2-L-Vβ or Vβ-L-Vα2, wherein L is a linker peptide that links a TCR variable β region (Vβ) with a TCR variable α region of the family 2 (Vα2), as discussed in International Patent Publication NO.: WO2011/044186; the contents of which are incorporated herein by reference in their entirety.

In one embodiment, the TCR specific to a TSA may be matured to increase its affinity to the TSA according to methods described in US Patent Publication NO.: US2014/0065111; the contents of which are incorporated herein by reference in their entirety.

In some embodiments, the TCRs may be specific to the Fc domain of an antibody (e.g. FcgRIa) and utilized to enhance efficacy of antibody mediated therapy, as discussed in International Patent Publication NO.: WO2015/179833; the contents of which are incorporated herein by reference in their entirety.

In some embodiments, payloads of the present invention may be recombinant constructs which act as trifunctional T-cell signaling couplers (TriTACs) mimicking the naturally signaling through T cell receptors. The TriTACs enhance chimeric receptor activity while retaining MHC unrestricted targeting. In some aspects, the recombinant construct may comprise a target specific binding ligand such as a scFV specific to a TSA or a designed ankyrin repeat (DARPin), a ligand that binds a protein associated with the TCR complex and a TCR signaling domain polypeptide, e.g. as described in the International Patent Application NO.: WO2015/117229; the contents of which are incorporated herein by reference in their entirety. The TCR associated proteins may be selected from CD3, ZAP70 9zeta-chain associated protein kinase 70), TYN and CD247. In some aspects, the ligand of a TriTAC that binds the TCR associated protein may be an antibody or an antibody fragment (e.g., scFv). In other aspects, the TCR signaling domain polypeptide of a TriTAC may comprise the transmembrane and cytoplasmic domain of CD4.

According to the present invention, the α chain and β chain of the TCR of the present invention may be included in separate constructs, for example as payloads of two effector modules. In other embodiments, the α chain and β chain of the TCR of the present invention may be included in a single effector module as two payloads of the same effector module, for example as illustrated in FIGS. 3-6.

5. Chimeric Antigen Receptors (CARs)

In some embodiments, payloads of the present invention may be a chimeric antigen receptors (CARs) which when transduced into immune cells (e.g., T cells and NK cells), can re-direct the immune cells against the target (e.g., a tumor cell) which expresses a molecule recognized by the extracellular target moiety of the CAR.

As used herein, the term "chimeric antigen receptor (CAR)" refers to a synthetic receptor that mimics TCR on the surface of T cells. In general, a CAR is composed of an extracellular targeting domain, a transmembrane domain/region and an intracellular signaling/activation domain. In a standard CAR receptor, the components: the extracellular targeting domain, transmembrane domain and intracellular signaling/activation domain, are linearly constructed as a single fusion protein. The extracellular region comprises a targeting domain/moiety (e.g., a scFv) that recognizes a specific tumor antigen or other tumor cell-surface molecules. The intracellular region may contain a signaling domain of TCR complex (e.g., the signal region of CD3ζ), and/or one or more costimulatory signaling domains, such as those from CD28, 4-1BB (CD137) and OX-40 (CD134). For example, a "first-generation CAR" only has the CD3ζ signaling domain, whereas in an effort to augment T-cell persistence and proliferation, costimulatory intracellular domains are added, giving rise to second generation CARs having a CD3ζ signal domain plus one costimulatory signaling domain, and third generation CARs having CD3ζ signal domain plus two or more costimulatory signaling domains. A CAR, when expressed by a T cell, endows the T cell with antigen specificity determined by the extracellular targeting moiety of the CAR. Recently, it is also desirable to add one or more elements such as homing and suicide genes to develop a more competent and safer architecture of CAR, so called the fourth-generation CAR.

Cells such as T cells engineered to express a CAR can be redirected to attack target cells that express a molecule which can be recognized by the targeting moiety of the CAR.

In some embodiments, the extracellular targeting domain is joined through the hinge (also called space domain or spacer) and transmembrane regions to an intracellular signaling domain. The hinge connects the extracellular targeting domain to the transmembrane domain which transverses the cell membrane and connects to the intracellular signaling domain. The hinge may need to be varied to optimize the potency of CAR transformed cells toward cancer cells due to the size of the target protein where the targeting moiety binds, and the size and affinity of the targeting domain itself. Upon recognition and binding of the targeting moiety to the target cell, the intracellular signaling domain leads to an activation signal to the CAR T cell, which is further amplified by the "second signal" from one or more intracellular costimulatory domains. The CAR T cell, once activated, can destroy the target cell.

In some embodiments, the CAR of the present invention may be split into two parts, each part is linked a dimerizing domain, such that an input that triggers the dimerization promotes assembly of the intact functional receptor. Wu and Lim recently reported a split CAR in which the extracellular CD19 binding domain and the intracellular signaling element are separated and linked to the FKBP domain and the FRB* (T2089L mutant of FKBP-rapamycin binding) domain that heterodimerize in the presence of the rapamycin analog AP21967. The split receptor is assembled in the presence of AP21967 and together with the specific antigen binding, activates T cells (Wu et al., *Science*, 2015, 625 (6258): aab4077).

In some embodiments, the CAR of the present invention may be designed as an inducible CAR. Sakemura et al recently reported the incorporation of a Tet-On inducible system to the CD19 CAR construct. The CD19 CAR is activated only in the presence of doxycycline (Dox). Sakemura reported that Tet-CD19CAR T cells in the presence of Dox were equivalently cytotoxic against CD19$^+$ cell lines and had equivalent cytokine production and proliferation upon CD19 stimulation, compared with conventional CD19CAR T cells (Sakemura et al., *Cancer Immuno. Res.*, 2016, June 21, Epub ahead of print). In one example, this Tet-CAR may be the payload of the effector module under the control of SREs (e.g., DDs) of the invention. The dual systems provide more flexibility to turn-on and off the CAR expression in transduced T cells.

According to the present invention, the payload of the present invention may be a first-generation CAR, or a second-generation CAR, or a third-generation CAR, or a fourth-generation CAR. Representative effector module embodiments comprising CAR constructs are illustrated in FIGS. 13-18. In some embodiments, the payload of the present invention may be a full CAR construct composed of the extracellular domain, the hinge and transmembrane domain and the intracellular signaling region. In other embodiments, the payload of the present invention may be a component of the full CAR construct including an extracellular targeting moiety, a hinge region, a transmembrane domain, an intracellular signaling domain, one or more co-stimulatory domain, and other additional elements that improve CAR architecture and functionality including but not limited to a leader sequence, a homing element and a safety switch, or the combination of such components.

CARs regulated by biocircuits and compositions of the present invention are tunable and thereby offer several advantages. The reversible on-off switch mechanism allows management of acute toxicity caused by excessive CAR-T cell expansion. Pulsatile CAR expression using SREs of the present invention may be achieved by cycling ligand level. The ligand conferred regulation of the CAR may be effective in offsetting tumor escape induced by antigen loss, avoiding functional exhaustion caused by tonic signaling due to chronic antigen exposure and improving the persistence of CAR expressing cells in vivo.

In some embodiments, biocircuits and compositions of the invention may be utilized to down regulate CAR expression to limit on target on tissue toxicity caused by tumor lysis syndrome. Down regulating the expression of the CARs of the present invention following anti-tumor efficacy may prevent (1) On target off tumor toxicity caused by antigen expression in normal tissue. (2) antigen independent activation in vivo.

Extracellular Targeting Domain/Moiety

In accordance with the invention, the extracellular target moiety of a CAR may be any agent that recognizes and binds to a given target molecule, for example, a neoantigen on tumor cells, with high specificity and affinity. The target moiety may be an antibody and variants thereof that specifically binds to a target molecule on tumor cells, or a peptide aptamer selected from a random sequence pool based on its ability to bind to the target molecule on tumor cells, or a variant or fragment thereof that can bind to the target molecule on tumor cells, or an antigen recognition domain from native T-cell receptor (TCR) (e.g. CD4 extracellular domain to recognize HIV infected cells), or exotic recognition components such as a linked cytokine that leads to recognition of target cells bearing the cytokine receptor, or a natural ligand of a receptor.

In some embodiments, the targeting domain of a CAR may be a Ig NAR, a Fab fragment, a Fab' fragment, a F(ab)'2 fragment, a F(ab)'3 fragment, Fv, a single chain variable fragment (scFv), a bis-scFv, a (scFv)2, a minibody, a diabody, a triabody, a tetrabody, a disulfide stabilized Fv protein (dsFv), a unitbody, a nanobody, or an antigen binding region derived from an antibody that specifically recognizes a target molecule, for example a tumor specific antigen (TSA). In one embodiment, the targeting moiety is a scFv antibody. The scFv domain, when it is expressed on the surface of a CAR T cell and subsequently binds to a target protein on a cancer cell, is able to maintain the CAR T cell in proximity to the cancer cell and to trigger the activation of the T cell. A scFv can be generated using routine recombinant DNA technology techniques and is discussed in the present invention.

In one embodiment, the targeting moiety of a CAR construct may be an aptamer such as a peptide aptamer that specifically binds to a target molecule of interest. The peptide aptamer may be selected from a random sequence pool based on its ability to bind to the target molecule of interest.

In some embodiments, the targeting moiety of a CAR construct may be a natural ligand of the target molecule, or a variant and/or fragment thereof capable of binding the target molecule. In some aspects, the targeting moiety of a CAR may be a receptor of the target molecule, for example, a full-length human CD27, as a CD70 receptor, may be fused in frame to the signaling domain of CD3 ζ forming a CD27 chimeric receptor as an immunotherapeutic agent for CD70-positive malignancies (See, e.g., US patent publication NO.: US20130323214; the contents of which are incorporated by reference herein in their entirety).

In some embodiments, the targeting moiety of a CAR may recognize a tumor specific antigen (TSA), for example a cancer neoantigen which is restrictedly expressed on tumor cells.

As non-limiting examples, the CAR of the present invention may comprise the extracellular targeting domain capable of binding to a tumor specific antigen selected from 5T4, 707-AP, A33, AFP (α-fetoprotein), AKAP-4 (A kinase anchor protein 4), ALK, a5031-integrin, androgen receptor, annexin II, alpha-actinin-4, ART-4, B1, B7H3, B7H4, BAGE (B melanoma antigen), BCMA, BCR-ABL fusion protein, beta-catenin, BKT-antigen, BTAA, CA-I (carbonic anhydrase I), CA50 (cancer antigen 50), CA125, CA15-3, CA195, CA242, calretinin, CAIX (carbonic anhydrase), CAMEL (cytotoxic T-lymphocyte recognized antigen on melanoma), CAM43, CAP-1, Caspase-8/m, CD4, CD5, CD7, CD19, CD20, CD22, CD23, CD25, CD27/m, CD28, CD30, CD33, CD34, CD36, CD38, CD40/CD154, CD41, CD44v6, CD44v7/8, CD45, CD49f, CD56, CD68KP1, CD74, CD79a/CD79b, CD103, CD123, CD133, CD138, CD171, cdc27/m, CDK4 (cyclin dependent kinase 4), CDKN2A, CDS, CEA (carcinoembryonic antigen), CEACAM5, CEACAM6, chromogranin, c-Met, c-Myc, coa-1, CSAp, CT7, CT10, cyclophilin B, cyclin B1, cytoplasmic tyrosine kinases, cytokeratin, DAM-10, DAM-6, dek-can fusion protein, desmin, DEPDC1 (DEP domain containing 1), E2A-PRL, EBNA, EGF-R (epidermal growth factor receptor), EGP-1(epithelial glycoprotein-1) (TROP-2), EGP-2, EGP-40, EGFR (epidermal growth factor receptor), EGFRvIII, EF-2, ELF2M, EMMPRIN, EpCAM (epithelial cell adhesion molecule), EphA2, Epstein Barr virus antigens, Erb (ErbB1; ErbB3; ErbB4), ETA (epithelial tumor antigen), ETV6-AML1 fusion protein, FAP (fibroblast activation protein), FBP (folate-binding protein), FGF-5, folate receptor α, FOS related antigen 1, fucosyl GM1, G250, GAGE (GAGE-1; GAGE-2), galactin, GD2 (ganglioside), GD3, GFAP (glial fibrillary acidic protein), GM2 (oncofetal antigen-immunogenic-1; OFA-I-1), GnT-V, Gp100, H4-RET, HAGE (helicase antigen), HER-2/neu, HIFs (hypoxia inducible factors), HIF-1α, HIF-2α, HLA-A2, HLA-A*0201-R170I, HLA-A11, HMWMAA, Hom/Mel-40, HSP70-2M (Heat shock protein 70), HST-2, HTgp-175, hTERT (or hTRT), human papillomavirus-E6/human papillomavirus-E7 and E6, iCE (immune-capture EIA), IGF-1R, IGH-IGK, IL2R, IL5, ILK (integrin-linked kinase), IMP3 (insulin-like growth factor II mRNA-binding protein 3), IRF4 (interferon regulatory factor 4), KDR (kinase insert domain receptor), KIAA0205, KRAB-zinc finger protein (KID)-3; KID31, KSA (17-1A), K-ras, LAGE, LCK, LDLR/FUT (LDLR-fucosyltransferaseAS fusion protein), LeY (Lewis Y), MAD-CT-1, MAGE (tyrosinase, melanoma-associated antigen) (MAGE-1; MAGE-3), melan-A tumor antigen (MART), MART-2/Ski, MC1R (melanocortin 1 receptor), MDM2, mesothelin, MPHOSPH1, MSA (muscle-specific actin), mTOR (mammalian targets of rapamycin), MUC-1, MUC-2, MUM-1 (melanoma associated antigen (mutated) 1), MUM-2, MUM-3, Myosin/m, MYL-RAR, NA88-A, N-acetylglucosaminyltransferase, neo-PAP, NF-KB (nuclear factor-kappa B), neurofilament, NSE (neuron-specific enolase), Notch receptors, NuMa, N-Ras, NY-BR-1, NY-CO-1, NY-ESO-1, Oncostatin M, OS-9, OY-TES1, p53 mutants, p190 minor bcr-abl, pl5(58), pl85erbB2, pl80erbB-3, PAGE (prostate associated gene), PAP (prostatic acid phosphatase), PAX3, PAX5, PDGFR (platelet derived growth factor receptor), cytochrome P450 involved in piperidine and pyrrolidine utilization (PIPA), Pml-RAR alpha fusion protein, PR-3 (proteinase 3), PSA (prostate specific antigen), PSM, PSMA (Prostate stem cell antigen), PRAME (preferentially expressed antigen of melanoma), PTPRK, RAGE (renal tumor antigen), Raf (A-Raf, B-Raf and C-Raf), Ras, receptor tyrosine kinases, RCAS 1, RGSS, ROR1 (receptor tyrosine kinase-like orphan receptor 1), RU1, RU2, SAGE, SART-1, SART-3, SCP-1, SDCCAGi6, SP-17 (sperm protein 17), src-family, SSX (synovial sarcoma X breakpoint)-1, SSX-2(HOM-MEL-40), SSX-3, SSX-4, SSX-5, STAT-3, STAT-5, STAT-6, STEAD, STn, survivin, syk-ZAP70, TA-90 (Mac-2 binding protein\cyclophilin C-associated protein), TAAL6, TACSTD1 (tumor associated calcium signal transducer 1), TACSTD2, TAG-72-4, TAGE, TARP (T cell receptor gamma alternate reading frame protein), TEL/AML1 fusion protein, TEM1, TEM8 (endosialin or CD248), TGFβ, TIE2, TLP, TMPRSS2 ETS fusion gene, TNF-receptor (TNF-α receptor, TNF-β receptor; or TNF-γ receptor), transferrin receptor, TPS, TRP-1 (tyrosine related protein 1), TRP-2, TRP-2/INT2, TSP-180, VEGF receptor, WNT, WT-1 (Wilm's tumor antigen) and XAGE.

In some embodiments, the CAR of the present invention may comprise a universal immune receptor which has a targeting moiety capable of binding to a labelled antigen. Methods of generating universal immune receptor CAR are discussed in International Patent Publication NO.: WO2013044225A1; the contents of which are incorporated herein by reference in their entirety.

In some embodiments, the CAR of the present invention may comprise the targeting moiety capable of binding to a pathogen antigen.

In some embodiments, the CAR of the present invention may comprise the targeting moiety capable of binding to non-protein molecules such as tumor-associated glycolipids and carbohydrates. TSAs may also be lipid molecules, polysaccharides, saccharides, nucleic acids, haptens, carbohydrate, or the combinations thereof.

In some embodiments, the CAR of the present invention may comprise the targeting moiety capable of binding to a component within the tumor microenvironment including proteins expressed in various tumor stroma cells including tumor associated macrophages (TAMs), immature monocytes, immature dendritic cells, immunosuppressive CD4$^+$ CD25$^+$ regulatory T cells (Treg) and MDSCs. A recent study using an animal model, demonstrated that after systemic transplantation, T cells expressing VEGFR-2 CAR and IL12 infiltrated the tumors, expanded and persisted within tumor mass leading to tumor regression. The anti-tumor effect was dependent on targeting of IL12-responsive host cells via activation of VEGFR-2 CAR-T cells and release of IL12 (Chinnasamy et al., *Clinical Cancer Research*, 2012, 18: 1672-1683).

In some embodiments, the CAR of the present invention may comprise the targeting moiety capable of binding to a cell surface adhesion molecule, a surface molecule of an inflammatory cell that appears in an autoimmune disease, or a TCR causing autoimmunity.

As non-limiting examples, the targeting moiety of the present invention may be a scFv antibody that recognizes a tumor specific antigen (TSA), for example scFvs of antibodies SS, SS1 and HN1 that specifically recognize and bind to human mesothelin (U.S. Pat. No. 9,359,447), scFv of antibody of GD2 (U.S. Pat. No. 9,315,585), a CD19 antigen binding domain (U.S. Pat. No. 9,328,156); a NKG2D ligand binding domain (U.S. Pat. No. 9,273,283; US patent publication NO.: US20160311906A1); human anti-mesothelin scFvs comprising the amino acid sequences of SEQ ID Nos.: 11 and 12 of U.S. Pat. No. 9,272,002; an anti-CS1 binding agent (US patent publication NO.: US20160075784); an anti-BCMA binding domain (International Patent Publication NO.: WO2016/014565); anti-CD19 scFv antibody of SEQ ID NO.: 20 in U.S. Pat. No. 9,102,761; GFR alpha 4 antigen binding fragments having the amino acid sequences of SEQ ID NOs: 59 and 79 of International patent publication NO.: 2016/025880; anti-CLL-1 (C-type lectin-like molecule 1) binding domains having the amino acid sequences of SEQ ID NO.:47, 44, 48, 49, 50, 39, 40, 41, 42, 43, 45, 46, 51, 73, 70, 74, 75, 76, 65, 66, 67, 68, 69, 71, 72, 77, 195, 86, 83, 87, 88, 89, 78, 79, 80, 81, 82, 84, 85, 90 and 196 of International Patent Publication NO.: WO2016014535); CD33 binding domains having the amino acid sequences of SEQ ID NOs: 39-46 of International patent publication NO.: WO2016014576; a GPC3 (glypican-3) binding domain (SEQ ID NO.: 2 and SEQ ID NO.: 4 of International patent publication NO.: WO2016036973); a GFR alpha4 (Glycosyl-phosphatidylinositol (GPI)-linked GDNF family α-receptor 4 cell-surface receptor) binding domain (International Patent Publication NO.: WO2016025880); CD123 binding domains having the amino acid sequences of SEQ ID NOs: 480, 483, 485, 478, 158, 159, 160, 157, 217, 218, 219, 216, 276, 277, 278, and 275 of International patent publication NO.: WO20160258896); an anti-ROR1 antibody or fragments thereof (International patent publication NO.: WO2016016344); scFvs specific to GPC-3 (SEQ ID NOs: 1 and 24 of International patent publication NO.: WO2016049459); scFv for CSPG4 (SEQ ID NO.: 2 of International patent publication NO.: WO2015080981; scFv for folate receptor alpha (US Patent Publication NO.: US20170002072A1); the contents of each of which are incorporated herein by reference in their entirety.

In some embodiments, natural ligands may be used as the targeting moieties of the CARs of the present invention. Such natural ligands may be capable of binding to the antigens with affinity in the range of the scFvs and can redirect T cells specificity and effector functions to target cells expressing the complementary receptor. In some embodiments, the targeting moiety of the CAR may be neuregulin-1 (NRG1) which is a natural ligand for HER3 and HER4; VEGF which is a natural ligand of VEGFR; IL13 wildtype protein or IL13 mutein e.g E13Y which binds to IL13Ra2; NKG2D ligand, which is a natural ligand of NKG2D receptor; CD70 which is ligand of CD27; and a proliferation-inducing ligand (APRIL) which is a natural high affinity ligand for BCMA8 and transmembrane activator and CAML interactor (TACI). Any of the ligand based BCMA CARs taught in the US Patent Publication No. US20160362467A1, the contents of which are incorporated by reference in their entirety.

In some embodiments, the targeting moieties of the present invention may be scFv comprising the amino acid sequences in Table 11.

TABLE 11

| | scFv sequences | | |
|---|---|---|---|
| Target | Description | SEQ ID NO | Source |
| Activated alpha.v. Beta.3 integrin receptor | scFv | 5474 | SEQ ID NO. 8 in US20090117096A1 |
| Activated alpha.v. Beta.3 integrin receptor | scFv | 5475 | SEQ ID NO. 2 in US20090117096A1 |

TABLE 11-continued scFv sequences

| Target | Description | SEQ ID NO | Source |
|---|---|---|---|
| Activated alpha.v. Beta.3 integrin receptor | scFv | 5476 | SEQ ID NO. 4 in US20090117096A1 |
| Adalimumab | scFv | 5477 | SEQ ID NO. 41 in US20160208021 |
| Adalinumab | scFv | 5478 | SEQ ID NO. 41 in WO2016112870 |
| ALK | scFv | 5479 | SEQ ID NO. 17 in WO2015069922 |
| ALK | scFv | 5480 | SEQ ID NO. 18 in WO2015069922 |
| ALK | scFv | 5481 | SEQ ID NO. 19 in WO2015069922 |
| ALK | scFv | 5482 | SEQ ID NO. 20 in WO2015069922 |
| ALK | scFv | 5483 | SEQ ID NO. 21 in WO2015069922 |
| ALK | scFv | 5484 | SEQ ID NO. 22 in WO2015069922 |
| ALK | scFv | 5485 | SEQ ID NO. 23 in WO2015069922 |
| ALK | scFv | 5486 | SEQ ID NO. 17 in US20160280798A1 |
| ALK | scFv | 5487 | SEQ ID NO. 18 in US20160280798A1 |
| ALK | scFv | 5488 | SEQ ID NO. 19 in US20160280798A1 |
| ALK | scFv | 5489 | SEQ ID NO. 20 in US20160280798A1 |
| ALK | scFv | 5490 | SEQ ID NO. 21 in US20160280798A1 |
| ALK | scFv | 5491 | SEQ ID NO. 22 in US20160280798A1 |
| ALK | scFv | 5492 | SEQ ID NO. 23 in US20160280798A1 |
| ALK | scFv | 5493 | SEQ ID NO. 24 in US20160280798A1 |
| ALK | scFv | 5494 | SEQ ID NO. 24 in WO2015069922 |
| B7H3 | scFv | 5495 | SEQ ID NO. 100 in WO2016033225 |
| B7H3 | scFv | 5496 | SEQ ID NO. 101 in WO2016033225 |
| B7H3 | scFv | 5497 | SEQ ID NO. 102 in WO2016033225 |
| B7H3 | scFv | 5498 | SEQ ID NO. 103 in WO2016033225 |
| B7H3 | scFv | 5499 | SEQ ID NO. 104 in WO2016033225 |
| B7H3 | scFv | 5500 | SEQ ID NO. 105 in WO2016033225 |
| B7H3 | scFv | 5501 | SEQ ID NO. 17 in WO2016033225 |
| B7H3 | scFv | 5502 | SEQ ID NO. 18 in WO2016033225 |
| B7H3 | scFv | 5503 | SEQ ID NO. 19 in WO2016033225 |
| B7H3 | scFv | 5504 | SEQ ID NO. 20 in WO2016033225 |
| B7H3 | scFv | 5505 | SEQ ID NO. 21 in WO2016033225 |
| B7H3 | scFv | 5506 | SEQ ID NO. 22 in WO2016033225 |
| B7H3 | scFv | 5507 | SEQ ID NO. 23 in WO2016033225 |
| B7H3 | scFv | 5508 | SEQ ID NO. 24 in WO2016033225 |
| B7H3 | scFv | 5509 | SEQ ID NO. 25 in WO2016033225 |
| B7H3 | scFv | 5510 | SEQ ID NO. 26 in WO2016033225 |
| B7H3 | scFv | 5511 | SEQ ID NO. 27 in WO2016033225 |
| B7H3 | scFv | 5512 | SEQ ID NO. 87 in WO2016033225 |
| B7H3 | scFv | 5513 | SEQ ID NO. 88 in WO2016033225 |
| B7H3 | scFv | 5514 | SEQ ID NO. 89 in WO2016033225 |
| B7H3 | scFv | 5515 | SEQ ID NO. 90 in WO2016033225 |
| B7H3 | scFv | 5516 | SEQ ID NO. 91 in WO2016033225 |
| B7H3 | scFv | 5517 | SEQ ID NO. 92 in WO2016033225 |
| B7H3 | scFv | 5518 | SEQ ID NO. 94 in WO2016033225 |
| B7H3 | scFv | 5519 | SEQ ID NO. 95 in WO2016033225 |
| B7H3 | scFv | 5520 | SEQ ID NO. 96 in WO2016033225 |
| B7H3 | scFv | 5521 | SEQ ID NO. 97 in WO2016033225 |
| B7H3 | scFv | 5522 | SEO ID NO. 98 in WO2016033225 |
| B7H3 | scFv | 5523 | SEQ ID NO. 99 in WO2016033225 |
| B7H4 | scFv | 5524 | SEQ ID NO. 1 in WO2013067492 |
| B7H4 | scFv | 5525 | SEQ ID NO. 2 in WO2013067492 |
| B7H4 | scFv | 5526 | SEQ ID NO. 3 in WO2013067492 |
| B7H4 | scFv | 5527 | SEQ ID NO. 4 in WO2013067492 |
| B7H4 | scFv | 5528 | SEQ ID NO. 1 in U.S. Pat. No. 9,422,351B2 |
| BCMA | scFv | 5529 | SEQ ID NO. 152 in WO2016168595A1 |
| BCMA | scFv | 5530 | SEQ ID NO. 158 in WO2016168595A1 |
| BCMA | scFv | 5531 | SEQ ID NO. 176 in WO2016168595A1 |
| BCMA | scFv | 5532 | SEQ ID NO. 182 in WO2016168595A1 |
| BCMA | scFv | 5533 | SEQ ID NO. 188 in WO2016168595A1 |
| BCMA | scFv | 5534 | SEQ ID NO. 200 in WO2016168595A1 |
| BCMA | scFv | 5535 | SEQ ID NO. 212 in WO2016168595A1 |
| BCMA | scFv | 5536 | SEQ ID NO. 218 in WO2016168595A1 |
| BCMA | scFv | 5537 | SEQ ID NO. 224 in WO2016168595A1 |
| BCMA | scFv | 5538 | SEQ ID NO. 284 in WO2016168595A1 |
| BCMA | scFv | 5539 | SEQ ID NO. 290 in WO2016168595A1 |
| BCMA | scFv | 5540 | SEQ ID NO. 296 in WO2016168595A1 |
| BCMA | scFv | 5541 | SEQ ID NO. 302 in WO2016168595A1 |
| BCMA | scFv | 5542 | SEQ ID NO. 314 in WO2016168595A1 |
| BCMA | scFv | 5543 | SEQ ID NO. 326 in WO2016168595A1 |
| BCMA | scFv | 5544 | SEQ ID NO. 344 in WO2016168595A1 |
| BCMA | scFv | 5545 | SEQ ID NO. 129 in WO2016014565 |
| BCMA | scFv | 5546 | SEQ ID NO. 130 in WO2016014565 |
| BCMA | scFv | 5547 | SEQ ID NO. 131 in WO2016014565 |
| BCMA | scFv | 5548 | SEQ ID NO. 132 in WO2016014565 |
| BCMA | scFv | 5549 | SEQ ID NO. 133 in WO2016014565 |
| BCMA | scFv | 5550 | SEQ ID NO. 134 in WO2016014565 |

TABLE 11-continued scFv sequences

| Target | Description | SEQ ID NO | Source |
|---|---|---|---|
| BCMA | scFv | 5551 | SEQ ID NO. 135 in WO2016014565 |
| BCMA | scFv | 5552 | SEQ ID NO. 136 in WO2016014565 |
| BCMA | scFv | 5553 | SEQ ID NO. 138 in WO2016014565 |
| BCMA | scFv | 5554 | SEQ ID NO. 139 in WO2016014565 |
| BCMA | scFv | 5555 | SEQ ID NO. 140 in WO2016014565 |
| BCMA | scFv | 5556 | SEQ ID NO. 141 in WO2016014565 |
| BCMA | scFv | 5557 | SEQ ID NO. 142 in WO2016014565 |
| BCMA | scFv | 5558 | SEQ ID NO. 143 in WO2016014565 |
| BCMA | scFv | 5559 | SEQ ID NO. 144 in WO2016014565 |
| BCMA | scFv | 5560 | SEQ ID NO. 145 in WO2016014565 |
| BCMA | scFv | 5561 | SEQ ID NO. 146 in WO2016014565 |
| BCMA | scFv | 5562 | SEQ ID NO. 147 in WO2016014565 |
| BCMA | scFv | 5563 | SEQ ID NO. 148 in WO2016014565 |
| BCMA | scFv | 5564 | SEQ ID NO. 149 in WO2016014565 |
| BCMA | scFv | 5565 | SEQ ID NO. 263 in WO2016014565 |
| BCMA | scFv | 5566 | SEQ ID NO. 264 in WO2016014565 |
| BCMA | scFv | 5567 | SEQ ID NO. 265 in WO2016014565 |
| BCMA | scFv | 5568 | SEQ ID NO. 266 in WO2016014565 |
| BCMA | scFv | 5569 | SEQ ID NO. 271 in WO2016014565 |
| BCMA | scFv | 5570 | SEQ ID NO. 273 in WO2016014565 |
| BCMA | scFv | 5571 | SEQ ID NO. 273 in WO2016014565 |
| BCMA | scFv | 5572 | SEQ ID NO. 39 in WO2016014565 |
| BCMA | scFv | 5573 | SEQ ID NO. 40 in WO2016014565 |
| BCMA | scFv | 5574 | SEQ ID NO. 41 in WO2016014565 |
| BCMA | scFv | 5575 | SEQ ID NO. 42 in WO2016014565 |
| BCMA | scFv | 5576 | SEQ ID NO. 43 in WO2016014565 |
| BCMA | scFv | 5577 | SEQ ID NO. 44 in WO2016014565 |
| BCMA | scFv | 5578 | SEQ ID NO. 45 in WO2016014565 |
| BCMA | scFv | 5579 | SEQ ID NO. 46 in WO2016014565 |
| BCMA | scFv | 5580 | SEQ ID NO. 47 in WO2016014565 |
| BCMA | scFv | 5581 | SEQ ID NO. 48 in WO2016014565 |
| BCMA | scFv | 5582 | SEQ ID NO. 49 in WO2016014565 |
| BCMA | scFv | 5583 | SEQ ID NO. 50 in WO2016014565 |
| BCMA | scFv | 5584 | SEQ ID NO. 51 in WO2016014565 |
| BCMA | scFv | 5585 | SEQ ID NO. 52 in WO2016014565 |
| BCMA | scFv | 5586 | SEQ ID NO. 53 in WO2016014565 |
| BCMA | scFv | 5587 | SEQ ID NO. 64 in WO2016014565 |
| BCMA | scFv | 5588 | SEQ ID NO. 129 in WO2016014565 |
| BCMA | scFv | 5589 | SEQ ID NO. 130 in WO2016014565 |
| BCMA | scFv | 5590 | SEQ ID NO. 131 in WO2016014565 |
| BCMA | scFv | 5591 | SEQ ID NO. 132 in WO2016014565 |
| BCMA | scFv | 5592 | SEQ ID NO. 133 in WO2016014565 |
| BCMA | scFv | 5593 | SEQ ID NO. 134 in WO2016014565 |
| BCMA | scFv | 5594 | SEQ ID NO. 135 in WO2016014565 |
| BCMA | scFv | 5595 | SEQ ID NO. 136 in WO2016014565 |
| BCMA | scFv | 5596 | SEQ ID NO. 137 in WO2016014565 |
| BCMA | scFv | 5597 | SEQ ID NO. 138 in WO2016014565 |
| BCMA | scFv | 5598 | SEQ ID NO. 139 in WO2016014565 |
| BCMA | scFv | 5599 | SEQ ID NO. 140 in WO2016014565 |
| BCMA | scFv | 5600 | SEQ ID NO. 141 in WO2016014565 |
| BCMA | scFv | 5601 | SEQ ID NO. 142 in WO2016014565 |
| BCMA | scFv | 5602 | SEQ ID NO. 143 in WO2016014565 |
| BCMA | scFv | 5603 | SEQ ID NO. 144 in WO2016014565 |
| BCMA | scFv | 5604 | SEQ ID NO. 145 in WO2016014565 |
| BCMA | scFv | 5605 | SEQ ID NO. 146 in WO2016014565 |
| BCMA | scFv | 5606 | SEQ ID NO. 147 in WO2016014565 |
| BCMA | scFv | 5607 | SEQ ID NO. 148 in WO2016014565 |
| BCMA | scFv | 5608 | SEQ ID NO. 149 in WO2016014565 |
| BCMA | scFv | 5609 | SEQ ID NO. 263 in WO2016014565 |
| BCMA | scFv | 5610 | SEQ ID NO. 264 in WO2016014565 |
| BCMA | scFv | 5611 | SEQ ID NO. 265 in WO2016014565 |
| BCMA | scFv | 5612 | SEQ ID NO. 266 in WO2016014565 |
| BCMA | scFv | 5613 | SEQ ID NO. 39 in WO2016014565 |
| BCMA | scFv | 5614 | SEQ ID NO. 40 in WO2016014565 |
| BCMA | scFv | 5615 | SEQ ID NO. 41 in WO2016014565 |
| BCMA | scFv | 5616 | SEQ ID NO. 42 in WO2016014565 |
| BCMA | scFv | 5617 | SEQ ID NO. 43 in WO2016014565 |
| BCMA | scFv | 5618 | SEQ ID NO. 44 in WO2016014565 |
| BCMA | scFv | 5619 | SEQ ID NO. 45 in WO2016014565 |
| BCMA | scFv | 5620 | SEQ ID NO. 46 in WO2016014565 |
| BCMA | scFv | 5621 | SEQ ID NO. 47 in WO2016014565 |
| BCMA | scFv | 5622 | SEQ ID NO. 48 in WO2016014565 |
| BCMA | scFv | 5623 | SEQ ID NO. 49 in WO2016014565 |
| BCMA | scFv | 5624 | SEQ ID NO. 50 in WO2016014565 |
| BCMA | scFv | 5625 | SEQ ID NO. 51 in WO2016014565 |
| BCMA | scFv | 5626 | SEQ ID NO. 52 in WO2016014565 |

TABLE 11-continued scFv sequences

| Target | Description | SEQ ID NO | Source |
|---|---|---|---|
| BCMA | scFv | 5627 | SEQ ID NO. 53 in WO2016014565 |
| BCMA | scFv | 5628 | SEQ ID NO. 214 in US20160311907A1 |
| BCMA | scFv | 5629 | SEQ ID NO. 215 in US20160311907A1 |
| BCMA | scFv | 5630 | SEQ ID NO. 216 in US20160311907A1 |
| BCMA | scFv | 5631 | SEQ ID NO. 217 in US20160311907A1 |
| BCMA | scFv | 5632 | SEQ ID NO. 218 in US20160311907A1 |
| BCMA | scFv | 5633 | SEQ ID NO. 219 in US20160311907A1 |
| BCMA | scFv | 5634 | SEQ ID NO. 220 in US20160311907A1 |
| BCMA | scFv | 5635 | SEQ ID NO. 221 in US20160311907A1 |
| BCMA | scFv | 5636 | SEQ ID NO. 222 in US20160311907A1 |
| BCMA | scFv | 5637 | SEQ ID NO. 223 in US20160311907A1 |
| BCMA | scFv | 5638 | SEQ ID NO. 224 in US20160311907A1 |
| BCMA | scFv | 5639 | SEQ ID NO. 225 in US20160311907A1 |
| BCMA | scFv | 5640 | SEQ ID NO. 226 in US20160311907A1 |
| BCMA | scFv | 5641 | SEQ ID NO. 227 in US20160311907A1 |
| BCMA | scFv | 5642 | SEQ ID NO. 228 in US20160311907A1 |
| BCMA | scFv | 5643 | SEQ ID NO. 229 in US20160311907A1 |
| BCMA | scFv | 5644 | SEQ ID NO. 230 in US20160311907A1 |
| BCMA | scFv | 5645 | SEQ ID NO. 231 in US20160311907A1 |
| BCMA | scFv | 5646 | SEQ ID NO. 232 in US20160311907A1 |
| BCMA | scFv | 5647 | SEQ ID NO. 233 in US20160311907A1 |
| BCMA | scFv | 5648 | SEQ ID NO. 234 in US20160311907A1 |
| BCMA | scFv | 5649 | SEQ ID NO. 235 in US20160311907A1 |
| BCMA | scFv | 5650 | SEQ ID NO. 236 in US20160311907A1 |
| BCMA | scFv | 5651 | SEQ ID NO. 237 in US20160311907A1 |
| BCMA | scFv | 5652 | SEQ ID NO. 238 in US20160311907A1 |
| BCMA | scFv | 5653 | SEQ ID NO. 239 in US20160311907A1 |
| BCMA | scFv | 5654 | SEQ ID NO. 240 in US20160311907A1 |
| BCMA | scFv | 5655 | SEQ ID NO. 241 in US20160311907A1 |
| BCMA | scFv | 5656 | SEQ ID NO. 242 in US20160311907A1 |
| BCMA | scFv | 5657 | SEQ ID NO. 243 in US20160311907A1 |
| BCMA | scFv | 5658 | SEQ ID NO. 244 in US20160311907A1 |
| BCMA | scFv | 5659 | SEQ ID NO. 245 in US20160311907A1 |
| BCMA | scFv | 5660 | SEQ ID NO. 246 in US20160311907A1 |
| BCMA | scFv | 5661 | SEQ ID NO. 247 in US20160311907A1 |
| BCMA | scFv | 5662 | SEQ ID NO. 248 in US20160311907A1 |
| BCMA | scFv | 5663 | SEQ ID NO. 249 in US20160311907A1 |
| BCMA | scFv | 5664 | SEQ ID NO. 251 in US20160311907A1 |
| CCR4 | scFv | 5665 | SEQ ID N0. 7 in WO2015191997 |
| CCR4 | scFv | 5666 | SEQ ID N0. 9 in WO2015191997 |
| CD123 | scFv | 5667 | SEQ ID NO. 157 in WO2016028896 |
| CD123 | scFv | 5668 | SEQ ID NO. 158 in WO2016028896 |
| CD123 | scFv | 5669 | SEQ ID NO. 159 in WO2016028896 |
| CD123 | scFv | 5670 | SEQ ID NO. 160 in WO2016028896 |
| CD123 | scFv | 5671 | SEQ ID NO. 184 in WO2016028896 |
| CD123 | scFv | 5672 | SEQ ID NO. 185 in WO2016028896 |
| CD123 | scFv | 5673 | SEQ ID NO. 186 in WO2016028896 |
| CD123 | scFv | 5674 | SEQ ID NO. 187 in WO2016028896 |
| CD123 | scFv | 5675 | SEQ ID NO. 188 in WO2016028896 |
| CD123 | scFv | 5676 | SEQ ID NO. 189 in WO2016028896 |
| CD123 | scFv | 5677 | SEQ ID NO. 190 in WO2016028896 |
| CD123 | scFv | 5678 | SEQ ID NO. 191 in WO2016028896 |
| CD123 | scFv | 5679 | SEQ ID NO. 192 in WO2016028896 |
| CD123 | scFv | 5680 | SEQ ID NO. 193 in WO2016028896 |
| CD123 | scFv | 5681 | SEQ ID NO. 194 in WO2016028896 |
| CD123 | scFv | 5682 | SEQ ID NO. 195 in WO2016028896 |
| CD123 | scFv | 5683 | SEQ ID NO. 196 in WO2016028896 |
| CD123 | scFv | 5684 | SEQ ID NO. 197 in WO2016028896 |
| CD123 | scFv | 5685 | SEQ ID NO. 198 in WO2016028896 |
| CD123 | scFv | 5686 | SEQ ID NO. 199 in WO2016028896 |
| CD123 | scFv | 5687 | SEQ ID NO. 200 in WO2016028896 |
| CD123 | scFv | 5688 | SEQ ID NO. 201 in WO2016028896 |
| CD123 | scFv | 5689 | SEQ ID NO. 202 in WO2016028896 |
| CD123 | scFv | 5690 | SEQ ID NO. 203 in WO2016028896 |
| CD123 | scFv | 5691 | SEQ ID NO. 204 in WO2016028896 |
| CD123 | scFv | 5692 | SEQ ID NO. 205 in WO2016028896 |
| CD123 | scFv | 5693 | SEQ ID NO. 206 in WO2016028896 |
| CD123 | scFv | 5694 | SEQ ID NO. 207 in WO2016028896 |
| CD123 | scFv | 5695 | SEQ ID NO. 208 in WO2016028896 |
| CD123 | scFv | 5696 | SEQ ID NO. 209 in WO2016028896 |
| CD123 | scFv | 5697 | SEQ ID NO. 210 in WO2016028896 |
| CD123 | scFv | 5698 | SEQ ID NO. 211 in WO2016028896 |
| CD123 | scFv | 5699 | SEQ ID NO. 212 in WO2016028896 |
| CD123 | scFv | 5700 | SEQ ID NO. 213 in WO2016028896 |
| CD123 | scFv | 5701 | SEQ ID NO. 214 in WO2016028896 |
| CD123 | scFv | 5702 | SEQ ID NO. 215 in WO2016028896 |

TABLE 11-continued scFv sequences

| Target | Description | SEQ ID NO | Source |
|---|---|---|---|
| CD123 | scFv | 5703 | SEQ ID NO. 36 in WO2015092024A2 |
| CD123 | scFv | 5704 | SEQ ID NO. 478 in WO2016028896 |
| CD123 | scFv | 5705 | SEQ ID NO. 480 in WO2016028896 |
| CD123 | scFv | 5706 | SEQ ID NO. 483 in WO2016028896 |
| CD123 | scFv | 5707 | SEQ ID NO. 485 in WO2016028896 |
| CD123 | scFv | 5708 | SEQ ID NO. 57 in WO2016115482A1 |
| CD123 | scFv | 5709 | SEQ ID NO. 36 in EP3083691A2 |
| CD123 | scFv | 5710 | SEQ ID NO. 157 in US20160311907A1 |
| CD124 | scFv | 5711 | SEQ ID NO. 158 in US20160311907A1 |
| CD125 | scFv | 5712 | SEQ ID NO. 159 in US20160311907A1 |
| CD126 | scFv | 5713 | SEQ ID NO. 160 in US2O16O311907A1 |
| CD127 | scFv | 5714 | SEQ ID NO. 161 in US20160311907A1 |
| CD128 | scFv | 5715 | SEQ ID NO. 162 in US20160311907A1 |
| CD129 | scFv | 5716 | SEQ ID NO. 163 in US20160311907A1 |
| CD130 | scFv | 5717 | SEQ ID NO. 164 in US20160311907A1 |
| CD131 | scFv | 5718 | SEQ ID NO. 165 in US20160311907A1 |
| CD138 | scFv | 5719 | SEQ ID NO. 36 in WO2016130598A1 |
| CD19 | scFv | 5720 | SEQ ID NO. 53 in EP3083671A1 |
| CD19 | scFv | 5721 | SEQ ID NO. 54 in EP3083671A1 |
| CD19 | scFv | 5722 | SEQ ID NO. 1 in WO2015157252 |
| CD19 | scFv | 5723 | SEQ ID NO. 10 in WO2015157252 |
| CD19 | scFv | 5724 | SEQ ID NO. 10 in WO2016033570 |
| CD19 | scFv | 5725 | SEQ ID NO. 11 in WO2015157252 |
| CD19 | scFv | 5726 | SEQ ID NO. 12 in WO2015157252 |
| CD19 | scFv | 5727 | SEQ ID NO. 2 in WO2015157252 |
| CD19 | scFv | 5728 | SEQ ID NO. 2 in WO2016033570 |
| CD19 | scFv | 5729 | SEQ ID NO. 206 in WO2016033570 |
| CD19 | scFv | 5730 | SEQ ID NO. 207 in WO2016033570 |
| CD19 | scFv | 5731 | SEQ ID NO. 208 in WO2016033570 |
| CD19 | scFv | 5732 | SEQ ID NO. 209 in WO2016033570 |
| CD19 | scFv | 5733 | SEQ ID NO. 210 in WO2016033570 |
| CD19 | scFv | 5734 | SEQ ID NO. 211 in WO2016033570 |
| CD19 | scFv | 5735 | SEQ ID NO. 213 in WO2016033570 |
| CD19 | scFv | 5736 | SEQ ID NO. 214 in WO2016033570 |
| CD19 | scFv | 5737 | SEQ ID NO. 215 in WO2016033570 |
| CD19 | scFv | 5738 | SEQ ID NO. 216 in WO2016033570 |
| CD19 | scFv | 5739 | SEQ ID NO. 217 in WO2016033570 |
| CD19 | scFv | 5740 | SEQ ID NO. 218 in WO2016033570 |
| CD19 | scFv | 5741 | SEQ ID NO. 219 in WO2016033570 |
| CD19 | scFv | 5742 | SEQ ID NO. 220 in WO2016033570 |
| CD19 | scFv | 5743 | SEQ ID NO. 221 in WO2016033570 |
| CD19 | scFv | 5744 | SEQ ID NO. 222 in WO2016033570 |
| CD19 | scFv | 5745 | SEQ ID NO. 223 in WO2016033570 |
| CD19 | scFv | 5746 | SEQ ID NO. 224 in WO2016033570 |
| CD19 | scFv | 5747 | SEQ ID NO. 225 in WO2016033570 |
| CD19 | scFv | 5748 | SEQ ID NO. 3 in WO2015157252 |
| CD19 | scFv | 5749 | SEQ ID NO. 4 in WO2015157252 |
| CD19 | scFv | 5750 | SEQ ID NO. 4 in WO2016033570 |
| CD19 | scFv | 5751 | SEQ ID NO. 45 in WO2016033570 |
| CD19 | scFv | 5752 | SEQ ID NO. 47 in WO2016033570 |
| CD19 | scFv | 5753 | SEQ ID NO. 49 in WO2016033570 |
| CD19 | scFv | 5754 | SEQ ID NO. 5 in WO2015155341A1 |
| CD19 | scFv | 5755 | SEQ ID NO. 5 in WO2015157252 |
| CD19 | scFv | 5756 | SEQ ID NO. 51 in WO2016033570 |
| CD19 | scFv | 5757 | SEQ ID NO. 53 in WO2016033570 |
| CD19 | scFv | 5758 | SEQ ID NO. 55 in WO2016033570 |
| CD19 | scFv | 5759 | SEQ ID NO. 57 in WO2016033570 |
| CD19 | scFv | 5760 | SEQ ID NO. 59 in WO2015157252 |
| CD19 | scFv | 5761 | SEQ ID NO. 59 in WO2016033570 |
| CD19 | scFv | 5762 | SEQ ID NO. 6 in WO2015157252 |
| CD19 | scFv | 5763 | SEQ ID NO. 6 in WO2016033570 |
| CD19 | scFv | 5764 | SEQ ID NO. 7 in WO2014184143 |
| CD19 | scFv | 5765 | SEQ ID NO. 7 in WO2015157252 |
| CD19 | scFv | 5766 | SEQ ID NO. 8 in WO2015157252 |
| CD19 | scFv | 5767 | SEQ ID NO. 8 in WO2016033570 |
| CD19 | scFv | 5768 | SEQ ID NO. 87 in WO2016033570 |
| CD19 | scFv | 5769 | SEQ ID NO. 9 in WO2015157252 |
| CD19 | scFv | 5770 | SEQ ID NO. 9 in WO2016139487 |
| CD19 | scFv | 5771 | SEQ ID NO. 10 in US20160152723 |
| CD19 | scFv | 5772 | SEQ ID NO. 2 in US20160152723 |
| CD19 | scFv | 5773 | SEQ ID NO. 206 in US20160152723 |
| CD19 | scFv | 5774 | SEQ ID NO. 207 in US20160152723 |
| CD19 | scFv | 5775 | SEQ ID NO. 208 in US20160152723 |
| CD19 | scFv | 5776 | SEQ ID NO. 209 in US20160152723 |
| CD19 | scFv | 5777 | SEQ ID NO. 210 in US20160152723 |
| CD19 | scFv | 5778 | SEQ ID NO. 211 in US20160152723 |

TABLE 11-continued

| | scFv sequences | | |
|---|---|---|---|
| Target | Description | SEQ ID NO | Source |
| CD19 | scFv | 5779 | SEQ ID NO. 212 in US20160152723 |
| CD19 | scFv | 5780 | SEQ ID NO. 213 in US20160152723 |
| CD19 | scFv | 5781 | SEQ ID NO. 214 in US20160152723 |
| CD19 | scFv | 5782 | SEQ ID NO. 215 in US20160152723 |
| CD19 | scFv | 5783 | SEQ ID NO. 216 in US20160152723 |
| CD19 | scFv | 5784 | SEQ ID NO. 217 in US20160152723 |
| CD19 | scFv | 5785 | SEQ ID NO. 218 in US20160152723 |
| CD19 | scFv | 5786 | SEQ ID NO. 219 in US20160152723 |
| CD19 | scFv | 5787 | SEQ ID NO. 220 in US20160152723 |
| CD19 | scFv | 5788 | SEQ ID NO. 221 in US20160152723 |
| CD19 | scFv | 5789 | SEQ ID NO. 222 in US20160152723 |
| CD19 | scFv | 5790 | SEQ ID NO. 223 in US20160152723 |
| CD19 | scFv | 5791 | SEQ ID NO. 224 in US20160152723 |
| CD19 | scFv | 5792 | SEQ ID NO. 225 in US20160152723 |
| CD19 | scFv | 5793 | SEQ ID NO. 32 in EP3083691A2 |
| CD19 | scFv | 5794 | SEQ ID NO. 35 in EP3083691A2 |
| CD19 | scFv | 5795 | SEQ ID NO. 38 in EP3083691A2 |
| CD19 | scFv | 5796 | SEQ ID NO. 4 in US20160152723 |
| CD19 | scFv | 5797 | SEQ ID NO. 45 in US20160152723 |
| CD19 | scFv | 5798 | SEQ ID NO. 47 in US20160152723 |
| CD19 | scFv | 5799 | SEQ ID NO. 49 in US20160152723 |
| CD19 | scFv | 5800 | SEQ ID NO. 51 in US20160152723 |
| CD19 | scFv | 5801 | SEQ ID NO. 53 in US20160152723 |
| CD19 | scFv | 5802 | SEQ ID NO. 55 in US20160152723 |
| CD19 | scFv | 5803 | SEQ ID NO. 57 in US20160152723 |
| CD19 | scFv | 5804 | SEQ ID NO. 59 in US20160152723 |
| CD19 | scFv | 5805 | SEQ ID NO. 6 in US20160152723 |
| CD19 | scFv | 5806 | SEQ ID NO. 8 in US20160152723 |
| CD19 | scFv | 5807 | SEQ ID NO. 87 in US20160152723 |
| CD19 | scFv | 5808 | SEQ ID NO. 89 in US20160152723 |
| CD19 | scFv | 5809 | SEQ ID NO. 39 in WO2016109410 |
| CD19 | scFv | 5810 | SEQ ID NO. 37 in EP3083671A1 |
| CD19 | scFv | 5811 | SEQ ID NO. 174 in WO2016115482A1 |
| CD19 | scFv | 5812 | SEQ ID NO. 20 in WO2012079000 |
| CD19 | scFv | 5813 | SEQ ID NO. 32 in WO2015092024A2 |
| CD19 | scFv | 5814 | SEQ ID NO. 33 in WO2015092024A2 |
| CD19 | scFv | 5815 | SEQ ID NO. 35 in WO2015092024A2 |
| CD19 | scFv | 5816 | SEQ ID NO. 38 in WO2015092024A2 |
| CD19 | scFv | 5817 | SEQ ID NO. 40 in WO2016109410 |
| CD19 | scFv | 5818 | SEQ ID NO. 41 in WO2016109410 |
| CD19 | scFv | 5819 | SEQ ID NO. 42 in WO2016109410 |
| CD19 | scFv | 5820 | SEQ ID NO. 43 in WO2016109410 |
| CD19 | scFv | 5821 | SEQ ID NO. 44 in WO2016109410 |
| CD19 | scFv | 5822 | SEQ ID NO. 45 in WO2016109410 |
| CD19 | scFv | 5823 | SEQ ID NO. 46 in WO2016109410 |
| CD19 | scFv | 5824 | SEQ ID NO. 47 in WO2016109410 |
| CD19 | scFv | 5825 | SEQ ID NO. 48 in WO2016109410 |
| CD19 | scFv | 5826 | SEQ ID NO. 49 in WO2016109410 |
| CD19 | scFv | 5827 | SEQ ID NO. 5 in WO2015155341A1 |
| CD19 | scFv | 5828 | SEQ ID NO. 50 in WO2016109410 |
| CD19 | scFv | 5829 | SEQ ID NO. 51 in WO2016109410 |
| CD19 | scFv | 5830 | SEQ ID NO. 7 in US20160145337A1 |
| CD19 | scFv | 5831 | SEQ ID NO. 9 in US20160145337A1 |
| CD19 | scFv | 5832 | SEQ ID NO. 20 in U.S. Pat. No. 9,499,629B2 |
| CD19 | scFv | 5833 | SEQ ID NO. 6 in WO2015155341A1 |
| CD19 | scFv | 5834 | SEQ ID NO. 73 in WO2016164580 |
| CD19 | scFv | 5835 | SEQ ID NO. 10 in US20160152723 |
| CD19 | scFv | 5836 | SEQ ID NO. 2 in US20160152723 |
| CD19 | scFv | 5837 | SEQ ID NO. 206 in US20160152723 |
| CD19 | scFv | 5838 | SEQ ID NO. 207 in US20160152723 |
| CD19 | scFv | 5839 | SEQ ID NO. 209 in US20160152723 |
| CD19 | scFv | 5840 | SEQ ID NO. 210 in US20160152723 |
| CD19 | scFv | 5841 | SEQ ID NO. 212 in US20160152723 |
| CD19 | scFv | 5842 | SEQ ID NO. 216 in US20160152723 |
| CD19 | scFv | 5843 | SEQ ID NO. 218 in US20160152723 |
| CD19 | scFv | 5844 | SEQ ID NO. 219 in US20160152723 |
| CD19 | scFv | 5845 | SEQ ID NO. 220 in US20160152723 |
| CD19 | scFv | 5846 | SEQ ID NO. 221 in US20160152723 |
| CD19 | scFv | 5847 | SEQ ID NO. 222 in US20160152723 |
| CD19 | scFv | 5848 | SEQ ID NO. 223 in US20160152723 |
| CD19 | scFv | 5849 | SEQ ID NO. 224 in US20160152723 |
| CD19 | scFv | 5850 | SEQ ID NO. 225 in US20160152723 |
| CD19 | scFv | 5851 | SEQ ID NO. 4 in US20160152723 |
| CD19 | scFv | 5852 | SEQ ID NO. 45 in US20160152723 |
| CD19 | scFv | 5853 | SEQ ID NO. 47 in US20160152723 |
| CD19 | scFv | 5854 | SEQ ID NO. 49 in US20160152723 |

TABLE 11-continued scFv sequences

| Target | Description | SEQ ID NO | Source |
|---|---|---|---|
| CD19 | scFv | 5855 | SEQ ID NO. 51 in US20160152723 |
| CD19 | scFv | 5856 | SEQ ID NO. 53 in US20160152723 |
| CD19 | scFv | 5857 | SEQ ID NO. 55 in US20160152723 |
| CD19 | scFv | 5858 | SEQ ID NO. 57 in US20160152723 |
| CD19 | scFv | 5859 | SEQ ID NO. 59 in US20160152723 |
| CD19 | scFv | 5860 | SEQ ID NO. 6 in US20160152723 |
| CD19 | scFv | 5861 | SEQ ID NO. 8 in US20160152723 |
| CD19 | scFv | 5862 | SEQ ID NO. 87 in US20160152723 |
| CD19 | scFv | 5863 | SEQ ID NO. 89 in US20160152723 |
| CD19 | scFv | 5864 | SEQ ID NO. 5 in WO2016055551 |
| CD19/CD22BiSpecific | scFv | 5865 | SEQ ID NO. 1303 in WO2016164731A2 |
| CD19/CD22BiSpecific | scFv | 5866 | SEQ ID NO. 1307 in WO2016164731A2 |
| CD20 | scFv | 5867 | SEQ ID NO. 691 in WO2016164731A100 |
| CD20 | scFv | 5868 | SEQ ID NO. 692 in WO2016164731A101 |
| CD20 | scFv | 5869 | SEQ ID NO. 693 in WO2016164731A102 |
| CD20 | scFv | 5870 | SEQ ID NO. 694 in WO2016164731A103 |
| CD20 | scFv | 5871 | SEQ ID NO. 695 in WO2016164731A104 |
| CD20 | scFv | 5872 | SEQ ID NO. 696 in WO2016164731A105 |
| CD20 | scFv | 5873 | SEQ ID NO. 175 in WO2016115482A1 |
| CD22 | scFv | 5874 | SEQ ID NO. 5 in WO2013059593 |
| CD22 | scFv | 5875 | SEQ ID NO. 6 in WO2013059593 |
| CD22 | scFv | 5876 | SEQ ID NO. 9 in US20150299317 |
| CD22 | scFv | 5877 | SEQ ID NO. 131 in WO2016164731A2 |
| CD22 | scFv | 5878 | SEQ ID NO. 132 in WO2016164731A2 |
| CD22 | scFv | 5879 | SEQ ID NO. 133 in WO2016164731A2 |
| CD22 | scFv | 5880 | SEQ ID NO. 134 in WO2016164731A2 |
| CD22 | scFv | 5881 | SEQ ID NO. 135 in WO2016164731A2 |
| CD22 | scFv | 5882 | SEQ ID NO. 136 in WO2016164731A2 |
| CD22 | scFv | 5883 | SEQ ID NO. 137 in WO2016164731A2 |
| CD22 | scFv | 5884 | SEQ ID NO. 138 in WO2016164731A2 |
| CD22 | scFv | 5885 | SEQ ID NO. 139 in WO2016164731A2 |
| CD22 | scFv | 5886 | SEQ ID NO. 140 in WO2016164731A2 |
| CD22 | scFv | 5887 | SEQ ID NO. 203 in WO2016164731A2 |
| CD22 | scFv | 5888 | SEQ ID NO. 209 in WO2016164731A2 |
| CD22 | scFv | 5889 | SEQ ID NO. 215 in WO2016164731A2 |
| CD22 | scFv | 5890 | SEQ ID NO. 221 in WO2016164731A2 |
| CD22 | scFv | 5891 | SEQ ID NO. 227 in WO2016164731A2 |
| CD22 | scFv | 5892 | SEQ ID NO. 232 in WO2016164731A2 |
| CD22 | scFv | 5893 | SEQ ID NO. 238 in WO2016164731A2 |
| CD22 | scFv | 5894 | SEQ ID NO. 244 in WO2016164731A2 |
| CD22 | scFv | 5895 | SEQ ID NO. 250 in WO2016164731A2 |
| CD22 | scFv | 5896 | SEQ ID NO. 256 in WO2016164731A2 |
| CD22 | scFv | 5897 | SEQ ID NO. 262 in WO2016164731A2 |
| CD22 | scFv | 5898 | SEQ ID NO. 268 in WO2016164731A2 |
| CD22 | scFv | 5899 | SEQ ID NO. 274 in WO2016164731A2 |
| CD22 | scFv | 5900 | SEQ ID NO. 280 in WO2016164731A2 |
| CD22 | scFv | 5901 | SEQ ID NO. 286 in WO2016164731A2 |
| CD22 | scFv | 5902 | SEQ ID NO. 292 in WO2016164731A2 |
| CD22 | scFv | 5903 | SEQ ID NO. 298 in WO2016164731A2 |
| CD22 | scFv | 5904 | SEQ ID NO. 304 in WO2016164731A2 |
| CD22 | scFv | 5905 | SEQ ID NO. 310 in WO2016164731A2 |
| CD22 | scFv | 5906 | SEQ ID NO. 316 in WO2016164731A2 |
| CD22 | scFv | 5907 | SEQ ID NO. 322 in WO2016164731A2 |
| CD22 | scFv | 5908 | SEQ ID NO. 328 in WO2016164731A2 |
| CD22 | scFv | 5909 | SEQ ID NO. 334 in WO2016164731A2 |
| CD22 | scFv | 5910 | SEQ ID NO. 340 in WO2016164731A2 |
| CD22 | scFv | 5911 | SEQ ID NO. 346 in WO2016164731A2 |
| CD22 | scFv | 5912 | SEQ ID NO. 352 in WO2016164731A2 |
| CD22 | scFv | 5913 | SEQ ID NO. 358 in WO2016164731A2 |
| CD22 | scFv | 5914 | SEQ ID NO. 364 in WO2016164731A2 |
| CD22 | scFv | 5915 | SEQ ID NO. 370 in WO2016164731A2 |
| CD22 | scFv | 5916 | SEQ ID NO. 376 in WO2016164731A2 |
| CD22 | scFv | 5917 | SEQ ID NO. 382 in WO2016164731A2 |
| CD22 | scFv | 5918 | SEQ ID NO. 388 in WO2016164731A2 |
| CD22 | scFv | 5919 | SEQ ID NO. 394 in WO2016164731A2 |
| CD22 | scFv | 5920 | SEQ ID NO. 400 in WO2016164731A2 |
| CD22 | scFv | 5921 | SEQ ID NO. 406 in WO2016164731A2 |
| CD22 | scFv | 5922 | SEQ ID NO. 412 in WO2016164731A2 |
| CD22 | scFv | 5923 | SEQ ID NO. 418 in WO2016164731A2 |
| CD22 | scFv | 5924 | SEQ ID NO. 423 in WO2016164731A2 |
| CD276 | scFv | 5925 | SEQ ID NO. 10 in US20160053017 |
| CD276 | scFv | 5926 | SEQ ID NO. 19 in US20160053017 |
| CD276 | scFv | 5927 | SEQ ID NO. 28 in US20160053017 |
| CD3 | scFv | 5928 | SEQ ID NO. 46 in WO2015153912A1 |
| CD3 | scFv | 5929 | SEQ ID NO. 47 in WO2015153912A1 |
| CD30 | scFv | 5930 | SEQ ID NO 20 in WO2016116035A1 |

TABLE 11-continued scFv sequences

| Target | Description | SEQ ID NO | Source |
|---|---|---|---|
| CD30 | scFv | 5931 | SEQ ID NO. 2 in US20160200824A1 |
| CD33 | scFv | 5932 | SEQ ID NO. 262 in WO2016014576 |
| CD33 | scFv | 5933 | SEQ ID NO. 263 in WO2016014576 |
| CD33 | scFv | 5934 | SEQ ID NO. 264 in WO2016014576 |
| CD33 | scFv | 5935 | SEQ ID NO. 265 in WO2016014576 |
| CD33 | scFv | 5936 | SEQ ID NO. 266 in WO2016014576 |
| CD33 | scFv | 5937 | SEQ ID NO. 267 in WO2016014576 |
| CD33 | scFv | 5938 | SEQ ID NO. 268 in WO2016014576 |
| CD33 | scFv | 5939 | SEQ ID NO. 37 in WO2015092024A2 |
| CD33 | scFv | 5940 | SEQ ID NO. 39 in WO2016014576 |
| CD33 | scFv | 5941 | SEQ ID NO. 40 in WO2016014576 |
| CD33 | scFv | 5942 | SEQ ID NO. 41 in WO2016014576 |
| CD33 | scFv | 5943 | SEQ ID NO. 42 in WO2016014576 |
| CD33 | scFv | 5944 | SEQ ID NO. 43 in WO2016014576 |
| CD33 | scFv | 5945 | SEQ ID NO. 44 in WO2016014576 |
| CD33 | scFv | 5946 | SEQ ID NO. 45 in WO2016014576 |
| CD33 | scFv | 5947 | SEQ ID NO. 46 in WO2016014576 |
| CD33 | scFv | 5948 | SEQ ID NO. 47 in WO2016014576 |
| CD33 | scFv | 5949 | SEQ ID NO. 37 in EP3083691A2 |
| CD33 | scFv | 5950 | SEQ ID NO. 153 in WO2016115482A1 |
| CD33 | scFv | 5951 | SEQ ID NO. 154 in WO2016115482A1 |
| CD33 | scFv | 5952 | SEQ ID NO. 155 in WO2016115482A1 |
| CD33 | scFv | 5953 | SEQ ID NO. 156 in WO2016115482A1 |
| CD33 | scFv | 5954 | SEQ ID NO. 157 in WO2016115482A1 |
| CD33 | scFv | 5955 | SEQ ID NO. 158 in WO2016115482A1 |
| CD33 | scFv | 5956 | SEQ ID NO. 159 in WO2016115482A1 |
| CD33 | scFv | 5957 | SEQ ID NO. 160 in WO2016115482A1 |
| CD33 | scFv | 5958 | SEQ ID NO. 161 in WO2016115482A1 |
| CD33 | scFv | 5959 | SEQ ID NO. 162 in WO2016115482A1 |
| CD33 | scFv | 5960 | SEQ ID NO. 163 in WO2016115482A1 |
| CD33/CD3sBiSpecifc | scFv | 5961 | SEQ ID NO. 33 in WO2014144722A2 |
| CD33/CD3sBiSpecifc | scFv | 5962 | SEQ ID NO. 34 in WO2014144722A2 |
| CD33/CD3sBiSpecifc | scFv | 5963 | SEQ ID NO. 84 in WO2014144722A2 |
| CD37 | | 5964 | SEQ ID NO. 21 in US20170000900 |
| CD37 | | 5965 | SEQ ID NO. 22 in US20170000900 |
| CD44 | scFv | 5966 | SEQ ID NO. 17 in WO2016042461A1 |
| CD46 | scFv | 5967 | SEQ ID NO. in WO2016040683 |
| CD46 | scFv | 5968 | SEQ ID NO. in WO2016040683 |
| CD46 | scFv | 5969 | SEQ ID NO. in WO2016040683 |
| CD46 | scFv | 5970 | SEQ ID NO. in WO2016040683 |
| CD46 | scFv | 5971 | SEQ ID NO. in WO2016040683 |
| CD46 | scFv | 5972 | SEQ ID NO. in WO2016040683 |
| CD46 | scFv | 5973 | SEQ ID NO. in WO2016040683 |
| CD46 | scFv | 5974 | SEQ ID NO. in WO2016040683 |
| CD46 | scFv | 5975 | SEQ ID NO. in WO2016040683 |
| CD46 | scFv | 5976 | SEQ ID NO. in WO2016040683 |
| CD46 | scFv | 5977 | SEQ ID NO. in WO2016040683 |
| CD46 | scFv | 5978 | SEQ ID NO. in WO2016040683 |
| CD46 | scFv | 5979 | SEQ ID NO. in WO2016040683 |
| CD46 | scFv | 5980 | SEQ ID NO. in WO2016040683 |
| CD46 | scFv | 5981 | SEQ ID NO. in WO2016040683 |
| CD46 | scFv | 5982 | SEQ ID NO. in WO2016040683 |
| CD46 | scFv | 5983 | SEQ ID NO. in WO2016040683 |
| CD46 | scFv | 5984 | SEQ ID NO. in WO2016040683 |
| CD46 | scFv | 5985 | SEQ ID NO. in WO2016040683 |
| CD46 | scFv | 5986 | SEQ ID NO. in WO2016040683 |
| CD46 | scFv | 5987 | SEQ ID NO. in WO2016040683 |
| CD46 | scFv | 5988 | SEQ ID NO. in WO2016040683 |
| CD46 | scFv | 5989 | SEQ ID NO. in WO2016040683 |
| CD5 | scFv | 5990 | SEQ ID NO. 16 in WO2016138491 |
| CD79b | scFv | 5991 | SEQ ID NO. 33 in US20160208021 |
| CEA | scFv | 5992 | SEQ ID NO. 1 in US20160303166A1 |
| CEA | scFv | 5993 | SEQ ID NO. 22 in US20140242701A1 |
| CEA | scFv | 5994 | SEQ ID NO. 22 in US20140242701A1 |
| Centuxiamb | scFv | 5995 | SEQ ID NO. 37 in WO2016112870 |
| Centuximab | scFv | 5996 | SEQ ID NO. 37 in US20160208021 |
| Claudin | scFv | 5997 | SEQ ID NO. 11 in WO2016073649A1 |
| Claudin | scFv | 5998 | SEQ ID NO. 17 in WO2014179759A1 |
| Claudin | scFv | 5999 | SEQ ID NO. 5 in WO2016073649A1 |
| Claudin | scFv | 6000 | SEQ ID NO. 7 in WO2016073649A1 |
| Claudin | scFv | 6001 | SEQ ID NO. 9 in WO2016073649A1 |
| Claudin6 | scFv | 6002 | SEQ ID NO. 164 in WO2016115482A1 |
| Claudin7 | scFv | 6003 | SEQ ID NO. 165 in WO2016115482A1 |
| Claudin8 | scFv | 6004 | SEQ ID NO. 166 in WO2016115482A1 |
| CLDN6 | scFv | 6005 | SEQ ID NO. 2 in WO2016150400 |
| CLDN7 | scFv | 6006 | SEQ ID NO. 4 in WO2016150400 |

TABLE 11-continued scFv sequences

| Target | Description | SEQ ID NO | Source |
|---|---|---|---|
| CLDN8 | scFv | 6007 | SEQ ID NO. 6 in WO2016150400 |
| CLL1 | scFv | 6008 | SEQ ID NO. 39 in WO2016014535 |
| CLL1 | scFv | 6009 | SEQ ID NO. 40 in WO2016014535 |
| CLL1 | scFv | 6010 | SEQ ID NO. 41 in WO2016014535 |
| CLL1 | scFv | 6011 | SEQ ID NO. 42 in WO2016014535 |
| CLL1 | scFv | 6012 | SEQ ID NO. 43 in WO2016014535 |
| CLL1 | scFv | 6013 | SEQ ID NO. 44 in WO2016014535 |
| CLL1 | scFv | 6014 | SEQ ID NO. 45 in WO2016014535 |
| CLL1 | scFv | 6015 | SEQ ID NO. 46 in WO2016014535 |
| CLL1 | scFv | 6016 | SEQ ID NO. 47 in WO2016014535 |
| CLL1 | scFv | 6017 | SEQ ID NO. 48 in WO2016014535 |
| CLL1 | scFv | 6018 | SEQ ID NO. 49 in WO2016014535 |
| CLL1 | scFv | 6019 | SEQ ID NO. 50 in WO2016014535 |
| CLL1 | scFv | 6020 | SEQ ID NO. 51 in WO2016014535 |
| CLL1 | scFv | 6021 | SEQ ID NO. 200 in US20160311907A1 |
| CLL1 | scFv | 6022 | SEQ ID NO. 201 in US20160311907A1 |
| CLL1 | scFv | 6023 | SEQ ID NO. 202 in US20160311907A1 |
| CLL1 | scFv | 6024 | SEQ ID NO. 203 in US20160311907A1 |
| CLL1 | scFv | 6025 | SEQ ID NO. 204 in US20160311907A1 |
| CLL1 | scFv | 6026 | SEQ ID NO. 205 in US20160311907A1 |
| CLL1 | scFv | 6027 | SEQ ID NO. 206 in US20160311907A1 |
| CLL1 | scFv | 6028 | SEQ ID NO. 207 in US20160311907A1 |
| CLL1 | scFv | 6029 | SEQ ID NO. 208 in US20160311907A1 |
| CLL1 | scFv | 6030 | SEQ ID NO. 209 in US20160311907A1 |
| CLL1 | scFv | 6031 | SEQ ID NO. 210 in US20160311907A1 |
| CLL1 | scFv | 6032 | SEQ ID NO. 211 in US20160311907A1 |
| CLL1 | scFv | 6033 | SEQ ID NO. 212 in US20160311907A1 |
| CLL1 | scFv | 6034 | SEQ ID NO. 213 in US20160311907A1 |
| CMet | scFv | 6035 | SEQ ID NO. 11 in US20040166544 |
| CMet | scFv | 6036 | SEQ ID NO. 12 in US20040166544 |
| CMet | scFv | 6037 | SEQ ID NO. 13 in US20040166544 |
| CMet | scFv | 6038 | SEQ ID NO. 14 in US20040166544 |
| CMet | scFv | 6039 | SEQ ID NO. 15 in US20040166544 |
| CMet | scFv | 6040 | SEQ ID NO. 16 in US20040166544 |
| CMet | scFv | 6041 | SEQ ID NO. 17 in US20040166544 |
| CMet | scFv | 6042 | SEQ ID NO. 18 in US20040166544 |
| CMet | scFv | 6043 | SEQ ID NO. 19 in US20040166544 |
| CMet | scFv | 6044 | SEQ ID NO. 2 in US20040166544 |
| CMet | scFv | 6045 | SEQ ID NO. 21 in US20040166544 |
| CMet | scFv | 6046 | SEQ ID NO. 22 in US20040166544 |
| CMet | scFv | 6047 | SEQ ID NO. 23 in US20040166544 |
| CMet | scFv | 6048 | SEQ ID NO. 25 in US20040166544 |
| CMet | scFv | 6049 | SEQ ID NO. 26 in US20040166544 |
| CMet | scFv | 6050 | SEQ ID NO. 26 in US20150299326 |
| CMet | scFv | 6051 | SEQ ID NO. 27 in US20040166544 |
| CMet | scFv | 6052 | SEQ ID NO. 27 in US20150299326 |
| CMet | scFv | 6053 | SEQ ID NO. 28 in US20040166544 |
| CMet | scFv | 6054 | SEQ ID NO. 28 in US20150299326 |
| CMet | scFv | 6055 | SEQ ID NO. 29 in US20150299326 |
| CMet | scFv | 6056 | SEQ ID NO. 3 in US20040166544 |
| CMet | scFv | 6057 | SEQ ID NO. 30 in US20150299326 |
| CMet | scFv | 6058 | SEQ ID NO. 30 in US20040166544 |
| CMet | scFv | 6059 | SEQ ID NO. 31 in US20040166544 |
| CMet | scFv | 6060 | SEQ ID NO. 32 in US20130034559 |
| CMet | scFv | 6061 | SEQ ID NO. 32 in US20150299326 |
| CMet | scFv | 6062 | SEQ ID NO. 33 in US20040166544 |
| CMet | scFv | 6063 | SEQ ID NO. 34 in US20040166544 |
| CMet | scFv | 6064 | SEQ ID NO. 35 in US20040166544 |
| CMet | scFv | 6065 | SEQ ID NO. 36 in US20040166544 |
| CMet | scFv | 6066 | SEQ ID NO. 37 in US20040166544 |
| CMet | scFv | 6067 | SEQ ID NO. 38 in US20040166544 |
| CMet | scFv | 6068 | SEQ ID NO. 39 in US20040166544 |
| CMet | scFv | 6069 | SEQ ID NO. 4 in US20040166544 |
| CMet | scFv | 6070 | SEQ ID NO. 40 in US20040166544 |
| CMet | scFv | 6071 | SEQ ID NO. 41 in US20040166544 |
| CMet | scFv | 6072 | SEQ ID NO. 42 in US20040166544 |
| CMet | scFv | 6073 | SEQ ID NO. 43 in US20040166544 |
| CMet | scFv | 6074 | SEQ ID NO. 44 in US20040166544 |
| CMet | scFv | 6075 | SEQ ID NO. 48 in US20040166544 |
| CMet | scFv | 6076 | SEQ ID NO. 49 in US20040166544 |
| CMet | scFv | 6077 | SEQ ID NO. 5 in US20040166544 |
| CMet | scFv | 6078 | SEQ ID NO. 50 in US20040166544 |
| CMet | scFv | 6079 | SEQ ID NO. 51 in US20040166544 |
| CMet | scFv | 6080 | SEQ ID NO. 52 in US20040166544 |
| CMet | scFv | 6081 | SEQ ID NO. 53 in US20040166544 |
| CMet | scFv | 6082 | SEQ ID NO. 54 in US20040166544 |

TABLE 11-continued scFv sequences

| Target | Description | SEQ ID NO | Source |
|---|---|---|---|
| CMet | scFv | 6083 | SEQ ID NO. 55 in US20040166544 |
| CMet | scFv | 6084 | SEQ ID NO. 56 in US20040166544 |
| CMet | scFv | 6085 | SEQ ID NO. 57 in US20040166544 |
| CMet | scFv | 6086 | SEQ ID NO. 58 in US20040166544 |
| CMet | scFv | 6087 | SEQ ID NO. 6 in US20040166544 |
| CMet | scFv | 6088 | SEQ ID NO. 60 in US20040166544 |
| CMet | scFv | 6089 | SEQ ID NO. 7 in US20040166544 |
| CMet | scFv | 6090 | SEQ ID NO. 9 in US20040166544 |
| CMet | scFv | 6091 | SEQ ID NO. 29 in US20040166544 |
| CS1 | scFv | 6092 | SEQ ID NO. 1 of WO2016090369 |
| CS1 | scFv | 6093 | SEQ ID NO. 17 in WO2014179759A1 |
| CSPG4 | scFv | 6094 | SEQ ID NO. 2 in WO2015080981 |
| CSPG4 | scFv | 6095 | SEQ ID NO. 2 in EP3074025A1 |
| CXCR4 | scFv | 6096 | SEQ ID NO. 83 in US20110020218 |
| CXCR4 | scFv | 6097 | SEQ ID NO. 85 in US20110020218 |
| CXCR4 | scFv | 6098 | SEQ ID NO. 86 in US20110020218 |
| CXCR4 | scFv | 6099 | SEQ ID NO. 89 in US20110020218 |
| E7MC | scFv | 6100 | SEQ ID NO. 223 in WO2016182957A1 |
| E7MC | scFv | 6101 | SEQ ID NO. 224 in WO2016182957A1 |
| E7MC | scFv | 6102 | SEQ ID NO. 225 in WO2016182957A1 |
| E7MC | scFv | 6103 | SEQ ID NO. 226 in WO2016182957A1 |
| E7MC | scFv | 6104 | SEQ ID NO. 227 in WO2016182957A1 |
| E7MC | scFv | 6105 | SEQ ID NO. 228 in WO2016182957A1 |
| E7MC | scFv | 6106 | SEQ ID NO. 229 in WO2016182957A1 |
| E7MC | scFv | 6107 | SEQ ID NO. 230 in WO2016182957A1 |
| E7MC | scFv | 6108 | SEQ ID NO. 231 in WO2016182957A1 |
| E7MC | scFv | 6109 | SEQ ID NO. 232 in WO2016182957A1 |
| EGFR | scFv | 6110 | SEQ ID NO. 11 in WO2014130657 |
| EGFR | scFv | 6111 | SEQ ID NO. 38 in WO2014130657 |
| EGFR | scFv | 6112 | SEQ ID NO. 41 in WO2014130657 |
| EGFR | scFv | 6113 | SEQ ID NO. 44 in WO2014130657 |
| EGFR | scFv | 6114 | SEQ ID NO. 47 in WO2014130657 |
| EGFR | scFv | 6115 | SEQ ID NO. 50 in WO2014130657 |
| EGFR | scFv | 6116 | SEQ ID NO. 53 in WO2014130657 |
| EGFR | scFv | 6117 | SEQ ID NO. 56 in WO2014130657 |
| EGFR | scFv | 6118 | SEQ ID NO. 59 in WO2014130657 |
| EGFR | scFv | 6119 | SEQ ID NO. 62 in WO2014130657 |
| EGFR | scFv | 6120 | SEQ ID NO. 65 in WO2014130657 |
| EGFR | scFv | 6121 | SEQ ID NO. 68 in WO2014130657 |
| EGFR | scFv | 6122 | SEQ ID NO. 71 in WO2014130657 |
| EGFR | scFv | 6123 | SEQ ID NO. 74 in WO2014130657 |
| EGFR | scFv | 6124 | SEQ ID NO. 77 in WO2014130657 |
| EGFR | scFv | 6125 | SEQ ID NO. 80 in WO2014130657 |
| EGFR | scFv | 6126 | SEQ ID NO. 83 in WO2014130657 |
| EGFR | scFv | 6127 | SEQ ID NO. 88 in WO2014130657 |
| EGFR | scFv | 6128 | SEQ ID NO. 91 in WO2014130657 |
| EGFR | scFv | 6129 | SEQ ID NO. 94 in WO2014130657 |
| EGFR | scFV | 6130 | |
| EGFR | scFv | 6131 | |
| EGFR | scFv | 6132 | |
| EGFR | scFv | 6133 | |
| EGFR | scFv | 6134 | |
| EGFR | scFv | 6135 | |
| EGFR | scFv | 6136 | |
| EGFR | scFv | 6137 | |
| EGFR | scFv | 6138 | |
| EGFR | scFv | 6139 | |
| EGFR | scFv | 6140 | |
| EGFR | scFv | 6141 | |
| EGFR | scFv | 6142 | |
| EGFR | scFv | 6143 | |
| EGFR | scFv | 6144 | |
| EGFR | scFv | 6145 | |
| EGFR | scFv | 6146 | |
| EGFR | scFv | 6147 | |
| EGFR | scFv | 6148 | |
| EGFR | scFv | 6149 | |
| EGFR | scFv | 6150 | |
| EGFR | scFv | 6151 | |
| EGFR | scFv | 6152 | |
| EGFR | scFv | 6153 | |
| EGFR | scFv | 6154 | |
| EGFR | scFv | 6155 | |
| EGFR | scFv | 6156 | |
| EGFRvIII | scFv | 6157 | SEQ ID NO. 5 in US20140037628 |
| EGFRvIII | scFv | 6158 | SEQ ID NO. 174 in US20160311907A1 |

TABLE 11-continued

| scFv sequences | | | |
|---|---|---|---|
| Target | Description | SEQ ID NO | Source |
| EGFRvIII | scFv | 6159 | SEQ ID NO. 38 in U.S. Pat. No. 9,394,368B2 |
| EGFRvIII | scFv | 6160 | SEQ ID NO. 5 in US20160200819A1 |
| END0180 | scFv | 6161 | SEQ ID NO. 6 in WO2013098813 |
| ERBB2 | scFv | 6162 | SEQ ID NO. 26 in US20110059076A1 |
| ERBB2 | scFv | 6163 | SEQ ID NO. 27 in US20110059076A1 |
| ERBB2 | scFv | 6164 | SEQ ID NO. 1 in U.S. Pat. No. 7,244,826 |
| ERBB2 | scFv | 6165 | SEQ ID NO. 2 in U.S. Pat. No. 7,244,826 |
| ESK/WT | scFv | 6166 | SEQ ID NO. 173 in WO2016115482A1 |
| FcRL5(FcReceptorLike5) | scFv | 6167 | SEQ ID NO. 11 in WO2016090337 |
| FcRL5(FcReceptorLike5) | scFv | 6168 | SEQ ID NO. 15 in WO2016090337 |
| FcRL5(FcReceptorLike5) | scFv | 6169 | SEQ ID NO. 19 in WO2016090337 |
| FcRL5(FcReceptorLike5) | scFv | 6170 | SEQ ID NO. 23 in WO2016090337 |
| FcRL5(FcReceptorLike5) | scFv | 6171 | SEQ ID NO. 27 in WO2016090337 |
| FcRL5(FcReceptorLike5) | scFv | 6172 | SEQ ID NO. 31 in WO2016090337 |
| FcRL5(FcReceptorLike5) | scFv | 6173 | SEQ ID NO. 35 in WO2016090337 |
| FcRL5(FcReceptorLike5) | scFv | 6174 | SEQ ID NO. 39 in WO2016090337 |
| FcRL5(FcReceptorLike5) | scFv | 6175 | SEQ ID NO. 3 in WO2016090337 |
| FcRL5(FcReceptorLike5) | scFv | 6176 | SEQ ID NO. 43 in WO2016090337 |
| FcRL5(FcReceptorLike5) | scFv | 6177 | SEQ ID NO. 7 in WO2016090337 |
| FcRL5(FcReceptorLike5) | scFv | 6178 | SEQ ID NO. 594 in WO2016090337 |
| FcRL5(FcReceptorLike5) | scFv | 6179 | SEQ ID NO. 596 in WO2016090337 |
| FcRL5(FcReceptorLike5) | scFv | 6180 | SEQ ID NO. 598 in WO2016090337 |
| FcRL5(FcReceptorLike5) | scFv | 6181 | SEQ ID NO. 600 in WO2016090337 |
| FcRL5(FcReceptorLike5) | scFv | 6182 | SEQ ID NO. 602 in WO2016090337 |
| FcRL5(FcReceptorLike5) | scFv | 6183 | SEQ ID NO. 604 in WO2016090337 |
| FcRL5(FcReceptorLike5) | scFv | 6184 | SEQ ID NO. 606 in WO2016090337 |
| FcRL5(FcReceptorLike5) | scFv | 6185 | SEQ ID NO. 608 in WO2016090337 |
| FcRL5(FcReceptorLike5) | scFv | 6186 | SEQ ID NO. 610 in WO2016090337 |
| FcRL5(FcReceptorLike5) | scFv | 6187 | SEQ ID NO. 612 in WO2016090337 |
| FcRL5(FcReceptorLike5) | scFv | 6188 | SEQ ID NO. 614 in WO2016090337 |
| FcRL5(FcReceptorLike5) | scFv | 6189 | SEQ ID NO. 616 in WO2016090337 |
| FcRL5(FcReceptorLike5) | scFv | 6190 | SEQ ID NO. 618 in WO2016090337 |
| FcRL5(FcReceptorLike5) | scFv | 6191 | SEQ ID NO. 620 in WO2016090337 |
| FcRL5(FcReceptorLike5) | scFv | 6192 | SEQ ID NO. 622 in WO2016090337 |
| FcRL5(FcReceptorLike5) | scFv | 6193 | SEQ ID NO. 624 in WO2016090337 |
| FcRL5(FcReceptorLike5) | scFv | 6194 | SEQ ID NO. 626 in WO2016090337 |
| FcRL5(FcReceptorLike5) | scFv | 6195 | SEQ ID NO. 628 in WO2016090337 |
| FcRL5(FcReceptorLike5) | scFv | 6196 | SEQ ID NO. 630 in WO2016090337 |
| FcRL5(FcReceptorLike5) | scFv | 6197 | SEQ ID NO. 632 in WO2016090337 |
| FcRL5(FcReceptorLike5) | scFv | 6198 | SEQ ID NO. 634 in WO2016090337 |
| FcRL5(FcReceptorLike5) | scFv | 6199 | SEQ ID NO. 636 in WO2016090337 |
| FcRL5(FcReceptorLike5) | scFv | 6200 | SEQ ID NO. 638 in WO2016090337 |
| FcRL5(FcReceptorLike5) | scFv | 6201 | SEQ ID NO. 640 in WO2016090337 |
| FcRL5(FcReceptorLike5) | scFv | 6202 | SEQ ID NO. 642 in WO2016090337 |
| FcRL5(FcReceptorLike5) | scFv | 6203 | SEQ ID NO. 644 in WO2016090337 |
| FcRL5(FcReceptorLike5) | scFv | 6204 | SEQ ID NO. 646 in WO2016090337 |
| FcRL5(FcReceptorLike5) | scFv | 6205 | SEQ ID NO. 648 in WO2016090337 |
| FcRL5(FcReceptorLike5) | scFv | 6206 | SEQ ID NO. 652 in WO2016090337 |
| FcRL5(FcReceptoiLike5) | scFv | 6207 | SEQ ID NO. 654 in WO2016090337 |
| FcRL5(FcReceptorLike5) | scFv | 6208 | SEQ ID NO. 656 in WO2016090337 |
| FcRL5(FcReceptorLike5) | scFv | 6209 | SEQ ID NO. 658 in WO2016090337 |
| FcRL5(FcReceptorLike5) | scFv | 6210 | SEQ ID NO. 660 in WO2016090337 |
| FcRL5(FcReceptorLike5) | scFv | 6211 | SEQ ID NO. 662 in WO2016090337 |
| FcRL5(FcReceptorLike5) | scFv | 6212 | SEQ ID NO. 664 in WO2016090337 |
| FcRL5(FcReceptorLike5) | scFv | 6213 | SEQ ID NO. 666 in WO2016090337 |
| FcRL5(FcReceptoiLike5) | scFv | 6214 | SEQ ID NO. 668 in WO2016090337 |
| FcRL5(FcReceptorLike5) | scFv | 6215 | SEQ ID NO. 670 in WO2016090337 |
| FcRL5(FcReceptorLike5) | scFv | 6216 | SEQ ID NO. 672 in WO2016090337 |
| FcRL5(FcReceptorLike5) | scFv | 6217 | SEQ ID NO. 674 in WO2016090337 |
| FcRL5(FcReceptorLike5) | scFv | 6218 | SEQ ID NO. 676 in WO2016090337 |
| FcRL5(FcReceptorLike5) | scFv | 6219 | SEQ ID NO. 678 in WO2016090337 |
| FcRL5(FcReceptorLike5) | scFv | 6220 | SEQ ID NO. 680 in WO2016090337 |
| FcRL5(FcReceptorLike5) | scFv | 6221 | SEQ ID NO. 682 in WO2016090337 |
| FcRL5(FcReceptorLike5) | scFv | 6222 | SEQ ID NO. 684 in WO2016090337 |
| FcRL5(FcReceptorLike5) | scFv | 6223 | SEQ ID NO. 686 in WO2016090337 |
| FcRL5(FcReceptorLike5) | scFv | 6224 | SEQ ID NO. 688 in WO2016090337 |
| FcRL5(FcReceptorLike5) | scFv | 6225 | SEQ ID NO. 690 in WO2016090337 |
| FcRL5(FcReceptorLike5) | scFv | 6226 | SEQ ID NO. 692 in WO2016090337 |
| FcRL5(FcReceptorLike5) | scFv | 6227 | SEQ ID NO. 694 in WO2016090337 |
| FcRL5(FcReceptorLike5) | scFv | 6228 | SEQ ID NO. 696 in WO2016090337 |
| FcRL5(FcReceptorLike5) | scFv | 6229 | SEQ ID NO. 700 in WO2016090337 |
| FcRL5(FcReceptorLike5) | scFv | 6230 | SEQ ID NO. 702 in WO2016090337 |
| FcRL5(FcReceptorLike5) | scFv | 6231 | SEQ ID NO. 704 in WO2016090337 |
| FcRL5(FcReceptorLike5) | scFv | 6232 | SEQ ID NO. 706 in WO2016090337 |
| FcRL5(FcReceptorLike5) | scFv | 6233 | SEQ ID NO. 708 in WO2016090337 |
| FcRL5(FcReceptorLike5) | scFv | 6234 | SEQ ID NO. 710 in WO2016090337 |

TABLE 11-continued

| | scFv sequences | | |
|---|---|---|---|
| Target | Description | SEQ ID NO | Source |
| FcRL5(FcReceptorLike5) | scFv | 6235 | SEQ ID NO. 712 in WO2016090337 |
| FcRL5(FcReceptorLike5) | scFv | 6236 | SEQ ID NO. 714 in WO2016090337 |
| FcRL5(FcReceptorLike5) | scFv | 6237 | SEQ ID NO. 716 in WO2016090337 |
| FcRL5(FcReceptorLike5) | scFv | 6238 | SEQ ID NO. 718 in WO2016090337 |
| FcRL5(FcReceptorLike5) | scFv | 6239 | SEQ ID NO. 720 in WO2016090337 |
| FcRL5(FcReceptorLike5) | scFv | 6240 | SEQ ID NO. 722 in WO2016090337 |
| FcRL5(FcReceptorLike5) | scFv | 6241 | SEQ ID NO. 724 in WO2016090337 |
| FcRL5(FcReceptorLike5) | scFv | 6242 | SEQ ID NO. 726 in WO2016090337 |
| FcRL5(FcReceptorLike5) | scFv | 6243 | SEQ ID NO. 728 in WO2016090337 |
| FcRL5(FcReceptorLike5) | scFv | 6244 | SEQ ID NO. 730 in WO2016090337 |
| FcRL5(FcReceptorLike5) | scFv | 6245 | SEQ ID NO. 732 in WO2016090337 |
| FcRL5(FcReceptorLike5) | scFv | 6246 | SEQ ID NO. 734 in WO2016090337 |
| FcRL5(FcReceptorLike5) | scFv | 6247 | SEQ ID NO. 736 in WO2016090337 |
| FcRL5(FcReceptorLike5) | scFv | 6248 | SEQ ID NO. 738 in WO2016090337 |
| FcRL5(FcReceptorLike5) | scFv | 6249 | SEQ ID NO. 740 in WO2016090337 |
| FcRL5(FcReceptorLike5) | scFv | 6250 | SEQ ID NO. 742 in WO2016090337 |
| FcRL5(FcReceptorLike5) | scFv | 6251 | SEQ ID NO. 744 in WO2016090337 |
| FcRL5(FcReceptorLike5) | scFv | 6252 | SEQ ID NO. 746 in WO2016090337 |
| FcRL5(FcReceptorLike5) | scFv | 6253 | SEQ ID NO. 748 in WO2016090337 |
| FcRL5(FcReceptorLike5) | scFv | 6254 | SEQ ID NO. 750 in WO2016090337 |
| FcRL5(FcReceptorLike5) | scFv | 6255 | SEQ ID NO. 752 in WO2016090337 |
| FcRL5(FcReceptorLike5) | scFv | 6256 | SEQ ID NO. 754 in WO2016090337 |
| FcRL5(FcReceptoiLike5) | scFv | 6257 | SEQ ID NO. 756 in WO2016090337 |
| FcRL5(FcReceptorLike5) | scFv | 6258 | SEQ ID NO. 758 in WO2016090337 |
| FcRL5(FcReceptorLike5) | scFv | 6259 | SEQ ID NO. 760 in WO2016090337 |
| FcRL5(FcReceptorLike5) | scFv | 6260 | SEQ ID NO. 762 in WO2016090337 |
| FcRL5(FcReceptorLike5) | scFv | 6261 | SEQ ID NO. 764 in WO2016090337 |
| FcRL5(FcReceptorLike5) | scFv | 6262 | SEQ ID NO. 766 in WO2016090337 |
| FcRL5(FcReceptorLike5) | scFv | 6263 | SEQ ID NO. 768 in WO2016090337 |
| FcRL5(FcReceptorLike5) | scFv | 6264 | SEQ ID NO. 770 in WO2016090337 |
| FcRL5(FcReceptorLike5) | scFv | 6265 | SEQ ID NO. 772 in WO2016090337 |
| FcRL5(FcReceptorLike5) | scFv | 6266 | SEQ ID NO. 774 in WO2016090337 |
| FcRL5(FcReceptorLike5) | scFv | 6267 | SEQ ID NO. 776 in WO2016090337 |
| FcRL5(FcReceptorLike5) | scFv | 6268 | SEQ ID NO. 778 in WO2016090337 |
| FcRL5(FcReceptorLike5) | scFv | 6269 | SEQ ID NO. 780 in WO2016090337 |
| FcRL5(FcReceptorLike5) | scFv | 6270 | SEQ ID NO. 782 in WO2016090337 |
| FcRL5(FcReceptorLike5) | scFv | 6271 | SEQ ID NO. 784 in WO2016090337 |
| FcRL5(FcReceptorLike5) | scFv | 6272 | SEQ ID NO. 786 in WO2016090337 |
| FcRL5(FcReceptorLike5) | scFv | 6273 | SEQ ID NO. 788 in WO2016090337 |
| FcRL5(FcReceptorLike5) | scFv | 6274 | SEQ ID NO. 790 in WO2016090337 |
| FcRL5(FcReceptorLike5) | scFv | 6275 | SEQ ID NO. 792 in WO2016090337 |
| FcRL5(FcReceptorLike5) | scFv | 6276 | SEQ ID NO. 794 in WO2016090337 |
| FcRL5(FcReceptorLike5) | scFv | 6277 | SEQ ID NO. 796 in WO2016090337 |
| FcRL5(FcReceptorLike5) | scFv | 6278 | SEQ ID NO. 798 in WO2016090337 |
| FcRL5(FcReceptorLike5) | scFv | 6279 | SEQ ID NO. 800 in WO2016090337 |
| FcRL5(FcReceptorLike5) | scFv | 6280 | SEQ ID NO. 802 in WO2016090337 |
| FcRL5(FcReceptorLike5) | scFv | 6281 | SEQ ID NO. 804 in WO2016090337 |
| FcRL5(FcReceptorLike5) | scFv | 6282 | SEQ ID NO. 806 in WO2016090337 |
| FcRL5(FcReceptorLike5) | scFv | 6283 | SEQ ID NO. 808 in WO2016090337 |
| FcRL5(FcReceptorLike5) | scFv | 6284 | SEQ ID NO. 810 in WO2016090337 |
| FcRL5(FcReceptorLike5) | scFv | 6285 | SEQ ID NO. 812 in WO2016090337 |
| FcRL5(FcReceptorLike5) | scFv | 6286 | SEQ ID NO. 814 in WO2016090337 |
| FcRL5(FcReceptorLike5) | scFv | 6287 | SEQ ID NO. 816 in WO2016090337 |
| FcRL5(FcReceptorLike5) | scFv | 6288 | SEQ ID NO. 818 in WO2016090337 |
| FcRL5(FcReceptorLike5) | scFv | 6289 | SEQ ID NO. 820 in WO2016090337 |
| FcRL5(FcReceptorLike5) | scFv | 6290 | SEQ ID NO. 822 in WO2016090337 |
| FcRL5(FcReceptorLike5) | scFv | 6291 | SEQ ID NO. 824 in WO2016090337 |
| FcRL5(FcReceptorLike5) | scFv | 6292 | SEQ ID NO. 826 in WO2016090337 |
| FcRL5(FcReceptorLike5) | scFv | 6293 | SEQ ID NO. 828 in WO2016090337 |
| FcRL5(FcReceptorLike5) | scFv | 6294 | SEQ ID NO. 830 in WO2016090337 |
| FcRL5(FcReceptorLike5) | scFv | 6295 | SEQ ID NO. 832 in WO2016090337 |
| FcRL5(FcReceptorLike5) | scFv | 6296 | SEQ ID NO. 834 in WO2016090337 |
| FcRL5(FcReceptorLike5) | scFv | 6297 | SEQ ID NO. 836 in WO2016090337 |
| FcRL5(FcReceptorLike5) | scFv | 6298 | SEQ ID NO. 838 in WO2016090337 |
| FcRL5(FcReceptorLike5) | scFv | 6299 | SEQ ID NO. 840 in WO2016090337 |
| FcRL5(FcReceptorLike5) | scFv | 6300 | SEQ ID NO. 842 in WO2016090337 |
| FcRL5(FcReceptorLike5) | scFv | 6301 | SEQ ID NO. 844 in WO2016090337 |
| FcRL5(FcReceptorLike5) | scFv | 6302 | SEQ ID NO. 846 in WO2016090337 |
| FcRL5(FcReceptorLike5) | scFv | 6303 | SEQ ID NO. 848 in WO2016090337 |
| FcRL5(FcReceptorLike5) | scFv | 6304 | SEQ ID NO. 850 in WO2016090337 |
| FcRL5(FcReceptorLike5) | scFv | 6305 | SEQ ID NO. 852 in WO2016090337 |
| FcRL5(FcReceptorLike5) | scFv | 6306 | SEQ ID NO. 854 in WO2016090337 |
| FcRL5(FcReceptorLike5) | scFv | 6307 | SEQ ID NO. 856 in WO2016090337 |
| FcRL5(FcReceptorLike5) | scFv | 6308 | SEQ ID NO. 858 in WO2016090337 |
| FcRL5(FcReceptorLike5) | scFv | 6309 | SEQ ID NO. 860 in WO2016090337 |
| FcRL5(FcReceptorLike5) | scFv | 6310 | SEQ ID NO. 862 in WO2016090337 |

TABLE 11-continued

| | scFv sequences | | |
|---|---|---|---|
| Target | Description | SEQ ID NO | Source |
| FcRL5(FcReceptorLike5) | scFv | 6311 | SEQ ID NO. 864 in WO2016090337 |
| FcRL5(FcReceptorLike5) | scFv | 6312 | SEQ ID NO. 866 in WO2016090337 |
| FcRL5(FcReceptorLike5) | scFv | 6313 | SEQ ID NO. 868 in WO2016090337 |
| FcRL5(FcReceptorLike5) | scFv | 6314 | SEQ ID NO. 870 in WO2016090337 |
| FcRL5(FcReceptorLike5) | scFv | 6315 | SEQ ID NO. 872 in WO2016090337 |
| FcRL5(FcReceptorLike5) | scFv | 6316 | SEQ ID NO. 874 in WO2016090337 |
| FcRL5(FcReceptorLike5) | scFv | 6317 | SEQ ID NO. 876 in WO2016090337 |
| FcRL5(FcReceptorLike5) | scFv | 6318 | SEQ ID NO. 878 in WO2016090337 |
| FcRL5(FcReceptorLike5) | scFv | 6319 | SEQ ID NO. 880 in WO2016090337 |
| FcRL5(FcReceptorLike5) | scFv | 6320 | SEQ ID NO. 882 in WO2016090337 |
| FcRL5(FcReceptorLike5) | scFv | 6321 | SEQ ID NO. 884 in WO2016090337 |
| FcRL5(FcReceptorLike5) | scFv | 6322 | SEQ ID NO. 886 in WO2016090337 |
| FcRL5(FcReceptorLike5) | scFv | 6323 | SEQ ID NO. 888 in WO2016090337 |
| FcRL5(FcReceptorLike5) | scFv | 6324 | SEQ ID NO. 890 in WO2016090337 |
| FcRL5(FcReceptorLike5) | scFv | 6325 | SEQ ID NO. 892 in WO2016090337 |
| FcRL5(FcReceptorLike5) | scFv | 6326 | SEQ ID NO. 894 in WO2016090337 |
| FcRL5(FcReceptorLike5) | scFv | 6327 | SEQ ID NO. 896 in WO2016090337 |
| FcRL5(FcReceptorLike5) | scFv | 6328 | SEQ ID NO. 650 in WO2016090337 |
| FcRL5(FcReceptorLike5) | scFv | 6329 | SEQ ID NO. 678 in WO2016090337 |
| Folate Receptor | scFv | 6330 | SEQ ID NO. 15 in US20170002072A1 |
| FOLR1/CD3sBiSpecific | scFv | 6331 | SEQ ID NO. 90 in WO2014144722A2 |
| GCN4 | scFv | 6332 | SEQ ID NO. 165 in WO2016168773A3 |
| GCN4 | scFv | 6333 | SEQ ID NO. 166 in WO2016168773A3 |
| GCN4 | scFv | 6334 | SEQ ID NO. 167 in WO2016168773A3 |
| GCN4 | scFv | 6335 | SEQ ID NO. 168 in WO2016168773A3 |
| GCN4 | scFv | 6336 | SEQ ID NO. 169 in WO2016168773A3 |
| GCN4 | scFv | 6337 | SEQ ID NO. 170 in WO2016168773A3 |
| GD2 | scFv | 6338 | SEQ ID NO. 19 in WO2016134284 |
| GD2 | scFv | 6339 | SEQ ID NO. 20 in WO2016134284 |
| GD2 | scFv | 6340 | SEQ ID NO. 21 in WO2016134284 |
| GD2 | scFv | 6341 | SEQ ID NO. 7 in WO2015132604 |
| GD2 | scFv | 6342 | SEQ ID NO. 8 in WO2015132604 |
| GPC3 | scFv | 6343 | SEQ ID NO. 1 in WO2016049459 |
| GPC3 | scFv | 6344 | SEQ ID NO. 12 in US20160208015A1 |
| GPC4 | scFv | 6345 | SEQ ID NO. 24 in WO2016049459 |
| GPRC5D | scFv | 6346 | SEQ ID NO. 100 in WO2016090312 |
| GPRC5D | scFv | 6347 | SEQ ID NO. 101 in WO2016090312 |
| GPRC5D | scFv | 6348 | SEQ ID NO. 102 in WO2016090312 |
| GPRC5D | scFv | 6349 | SEQ ID NO. 103 in WO2016090312 |
| GPRC5D | scFv | 6350 | SEQ ID NO. 104 in WO2016090312 |
| GPRC5D | scFv | 6351 | SEQ ID NO. 105 in WO2016090312 |
| GPRC5D | scFv | 6352 | SEQ ID NO. 106 in WO2016090312 |
| GPRC5D | scFv | 6353 | SEQ ID NO. 107 in WO2016090312 |
| GPRC5D | scFv | 6354 | SEQ ID NO. 108 in WO2016090312 |
| GPRC5D | scFv | 6355 | SEQ ID NO. 109 in WO2016090312 |
| GPRC5D | scFv | 6356 | SEQ ID NO. 110 in WO2016090312 |
| GPRC5D | scFv | 6357 | SEQ ID NO. 111 in WO2016090312 |
| GPRC5D | scFv | 6358 | SEQ ID NO. 112 in WO2016090312 |
| GPRC5D | scFv | 6359 | SEQ ID NO. 113 in WO2016090312 |
| GPRC5D | scFv | 6360 | SEQ ID NO. 114 in WO2016090312 |
| GPRC5D | scFv | 6361 | SEQ ID NO. 115 in WO2016090312 |
| GPRC5D | scFv | 6362 | SEQ ID NO. 116 in WO2016090312 |
| GPRC5D | scFv | 6363 | SEQ ID NO. 117 in WO2016090312 |
| GPRC5D | scFv | 6364 | SEQ ID NO. 118 in WO2016090312 |
| GPRC5D | scFv | 6365 | SEQ ID NO. 119 in WO2016090312 |
| GPRC5D | scFv | 6366 | SEQ ID NO. 120 in WO2016090312 |
| GPRC5D | scFv | 6367 | SEQ ID NO. 121 in WO2016090312 |
| GPRC5D | scFv | 6368 | SEQ ID NO. 122 in WO2016090312 |
| GPRC5D | scFv | 6369 | SEQ ID NO. 123 in WO2016090312 |
| GPRC5D | scFv | 6370 | SEQ ID NO. 301 in WO2016090312 |
| GPRC5D | scFv | 6371 | SEQ ID NO. 313 in WO2016090312 |
| GPRC5D | scFv | 6372 | SEQ ID NO. 325 in WO2016090312 |
| GPRC5D | scFv | 6373 | SEQ ID NO. 337 in WO2016090312 |
| GPRC5D | scFv | 6374 | SEQ ID NO. 349 in WO2016090312 |
| GPRC5D | scFv | 6375 | SEQ ID NO. 361 in WO2016090312 |
| GPRC5D | scFv | 6376 | SEQ ID NO. 373 in WO2016090312 |
| GPRC5D | scFv | 6377 | SEQ ID NO. 385 in WO2016090312 |
| HER2/CD3 | scFv | 6378 | SEQ ID N0. 9 in WO2014144722A2 |
| humanCD79b1F10 | scFv | 6379 | SEQ ID NO. 33 in WO2016112870 |
| Human collagen VII | scFv | 6380 | SEQ ID NO. 34 in WO2016112870 |
| Integrin Bivalent | scFv | 6381 | SEQ ID N0. 2 in WO2009070753 |
| Integrin Bivalent | scFv | 6382 | SEQ ID NO. 1 in WO2009070753 |
| Ipilimumab | scFv | 6383 | SEQ ID NO. 39 in US20160208021 |
| Ipilimumab | scFv | 6384 | SEQ ID NO. 39 in WO2016112870 |
| IL4 | scFv | 6385 | SEQ ID NO. 17 in WO2009121847 |
| IL4R | scFv | 6386 | SEQ ID NO. 16 in WO2009121847 |

TABLE 11-continued scFv sequences

| Target | Description | SEQ ID NO | Source |
|---|---|---|---|
| Mec/CD3sBispecific | scFv | 6387 | SEQ ID NO. 78 in WO2014144722A2 |
| Mesothelin | scFv | 6388 | SEQ ID NO. 7 WO2015188141 |
| Mesothelin | scFv | 6389 | SEQ ID NO 47 in WO2016090034 |
| Mesothelin | scFv | 6390 | SEQ ID NO in 46 in WO2016090034 |
| Mesothelin | scFv | 6391 | SEQ ID NO in 57 in WO2016090034 |
| Mesothelin | scFv | 6392 | SEQ ID NO. 48 in WO2016090034 |
| Mesothelin | scFv | 6393 | SEQ ID NO. 49 in WO2016090034 |
| Mesothelin | scFv | 6394 | SEQ ID NO. 50 in WO2016090034 |
| Mesothelin | scFv | 6395 | SEQ ID NO. 51 in WO2016090034 |
| Mesothelin | scFv | 6396 | SEQ ID NO. 53 in WO2016090034 |
| Mesothelin | scFv | 6397 | SEQ ID NO. 54 in WO2016090034 |
| Mesothelin | scFv | 6398 | SEQ ID NO. 55 in WO2016090034 |
| Mesothelin | scFv | 6399 | SEQ ID NO. 56 in WO2016090034 |
| Mesothelin | scFv | 6400 | SEQ ID NO. 58 in WO2016090034 |
| Mesothelin | scFv | 6401 | SEQ ID NO. 59 WO2016090034 |
| Mesothelin | scFv | 6402 | SEQ ID NO. 62 in WO2016090034 |
| Mesothelin | scFv | 6403 | SEQ ID NO. 64 in WO2016090034 |
| Mesothelin | scFv | 6404 | SEQ ID NO. 65 in WO2016090034 |
| Mesothelin | scFv | 6405 | SEQ ID NO. 66 in WO2016090034 |
| Mesothelin | scFv | 6406 | SEQ ID NO. 67 in WO2016090034 |
| Mesothelin | scFv | 6407 | SEQ ID NO. 68 in WO2016090034 |
| Mesothelin | scFv | 6408 | SEQ ID NO. 69 in WO2016090034 |
| Mesothelin | scFv | 6409 | SEQ ID NO. 7 WO2015188141 |
| Mesothelin | scFv | 6410 | SEQ ID NO. 70 in WO2016090034 |
| Mesothelin | scFv | 6411 | SEQ ID NO. 52 in WO2016090034 |
| Mesothelin | scFv | 6412 | SEQ ID NO. 60 in WO2016090034 |
| Mesothelin | scFv | 6413 | SEQ ID NO. 61 in WO2016090034 |
| Mesothelin | scFv | 6414 | SEQ ID NO. 63 in WO2016090034 |
| Mesothelin | scFv | 6415 | SEQ ID NO. 10 in WO2013142034 |
| Mesothelin | scFv | 6416 | SEQ ID NO. 11 in WO2013142034 |
| Mesothelin | scFv | 6417 | SEQ ID NO. 12 in WO2013142034 |
| Mesothelin | scFv | 6418 | SEQ ID NO. 11 in WO2013063419 |
| MUC1 | scFv | 6419 | SEQ ID NO. 15 in US20160130357 |
| MUC2 | scFv | 6420 | SEQ ID NO. 17 in US20160130357 |
| MUC3 | scFv | 6421 | SEQ ID NO. 15 in US20160130357 |
| MUC4 | scFv | 6422 | SEQ ID NO. 17 in US20160130357 |
| Nivolumab | scFv | 6423 | SEQ ID NO. 38 in US20160208021 |
| Nivolumab | scFv | 6424 | SEQ ID NO. 38 in WO2016112870 |
| NYBR1 | scFv | 6425 | SEQ ID NO. 21 in US20160333422A1 |
| NYBR1 | scFv | 6426 | SEQ ID NO. 21 in WO2015112830 |
| NYBR1 | scFv | 6427 | SEQ ID NO. 18 in WO2015112830 |
| NYBR1 | scFv | 6428 | SEQ ID NO. 19 in WO2015112830 |
| O acetylated GD2 ganglioside | scFv | 6429 | SEQ ID NO. 29 in US20150140023 |
| O acetylated GD2 ganglioside | scFv | 6430 | SEQ ID NO. 31 in US20150140023 |
| OX40 | scFv | 6431 | SEQ ID NO. 33 in US20150190506 |
| PD1 | scFv | 6432 | SEQ ID NO. 39 in US20160311917A1 |
| PD1 | scFv | 6433 | SEQ ID NO. 40 in US20160311917A1 |
| PD1 | scFv | 6434 | SEQ ID NO. 41 in US20160311917A1 |
| PD1 | scFv | 6435 | SEQ ID NO. 42 in US20160311917A1 |
| PD1 | scFv | 6436 | SEQ ID NO. 43 in US20160311917A1 |
| PD1 | scFv | 6437 | SEQ ID NO. 44 in US20160311917A1 |
| PD1 | scFv | 6438 | SEQ ID NO. 45 in US20160311917A1 |
| PD1 | scFv | 6439 | SEQ ID NO. 46 in US20160311917A1 |
| PD1 | scFv | 6440 | SEQ ID NO. 47 in US20160311917A1 |
| PD1 | scFv | 6441 | SEQ ID NO. 48 in US20160311917A1 |
| PD1 | scFv | 6442 | SEQ ID NO. 49 in US20160311917A1 |
| PD1 | scFv | 6443 | SEQ ID NO. 50 in US20160311917A1 |
| PD1 | scFv | 6444 | SEQ ID NO. 51 in US20160311917A1 |
| PD1 | scFv | 6445 | SEQ ID NO. 52 in US20160311917A1 |
| PD1 | scFv | 6446 | SEQ ID NO. 53 in US20160311917A1 |
| PD1 | scFv | 6447 | SEQ ID NO. 54 in US2O16O311917A1 |
| PD1 | scFv | 6448 | SEQ ID NO. 55 in US20160311917A1 |
| PD1 | scFv | 6449 | SEQ ID NO. 56 in US20160311917A1 |
| PD1 | scFv | 6450 | SEQ ID NO. 57 in US20160311917A1 |
| PD1 | scFv | 6451 | SEQ ID NO. 58 in US20160311917A1 |
| PD1 | scFv | 6452 | SEQ ID NO. 59 in US20160311917A1 |
| PD1 | scFv | 6453 | SEQ ID NO. 60 in US20160311917A1 |
| PD1 | scFv | 6454 | SEQ ID NO. 61 in US20160311917A1 |
| PDK1 | scFv | 6455 | SEQ ID NO. 15 in WO2016090365 |
| PDL1 | Nanobody | 6456 | SEQ ID NO. 22 in US20110129458 |
| PDL1 | Nanobody | 6457 | SEQ ID NO. 23 in US20110129458 |
| PDL1 | Nanobody | 6458 | SEQ ID NO. 24 in US20110129458 |
| PDL1 | Nanobody | 6459 | SEQ ID NO. 25 in US20110129458 |
| PDL1 | Nanobody | 6460 | SEQ ID NO. 26 in US20110129458 |
| PDL1 | Nanobody | 6461 | SEQ ID NO. 27 in US20110129458 |
| PDL2 | Nanobody | 6462 | SEQ ID NO. 28 in US20110129458 |

TABLE 11-continued

| scFv sequences | | | |
|---|---|---|---|
| Target | Description | SEQ ID NO | Source |
| PDL2 | Nanobody | 6463 | SEQ ID NO. 29 in US20110129458 |
| PDL2 | Nanobody | 6464 | SEQ ID NO. 30 in US20110129458 |
| PDL2 | Nanobody | 6465 | SEQ ID NO. 31 in US20110129458 |
| PDL2 | Nanobody | 6466 | SEQ ID NO. 32 in US20110129458 |
| PDL2 | Nanobody | 6467 | SEQ ID NO. 33 in US20110129458 |
| PRAME | scFv | 6468 | SEQ ID NO. 63 in WO2016191246A2 |
| PRAME | scFv | 6469 | SEQ ID NO. 64 in WO2016191246A2 |
| PRAME | scFv | 6470 | SEQ ID NO. 65 in WO2016191246A2 |
| PRAME | scFv | 6471 | SEQ ID NO. 66 in WO2016191246A2 |
| PRAME | scFv | 6472 | SEQ ID NO. 67 in WO2016191246A2 |
| PRAME | scFv | 6473 | SEQ ID NO. 68 in WO2016191246A2 |
| PRAME | scFv | 6474 | SEQ ID NO. 69 in WO2016191246A2 |
| PSMA | scFv | 6475 | SEQ ID NO. 19 in WO2012145714 |
| PSMA | scFv | 6476 | SEQ ID NO. 21 in WO2012145714 |
| PSMA | scFv | 6477 | SEQ ID NO. 30 in WO2012145714 |
| PSMA | scFv | 6478 | SEQ ID NO. 31 in WO2012145714 |
| PSMA | scFv | 6479 | SEQ ID NO. 34 in WO2012145714 |
| PSMA | scFv | 6480 | SEQ ID NO. 35 in WO2012145714 |
| PSMA | Diabody | 6481 | SEQ ID NO. 12 in WO2011069019 |
| PSMA | Diabody | 6482 | SEQ ID NO. 13 in WO2011069019 |
| PSMA | Diabody | 6483 | SEQ ID NO. 14 in WO2011069019 |
| PSMA | Diabody | 6484 | SEQ ID NO. 15 in WO2011069019 |
| radiation inducible neoantigen | scFv | 6485 | SEQ ID NO 22 in WO2005042780A1 |
| radiation inducible neoantigen | scFv | 6486 | SEQ ID NO 24 in WO2005042780A1 |
| Ranibizuman | scFv | 6487 | SEQ ID NO. 40 in US20160208021 |
| Ranibizuman | scFv | 6488 | SEQ ID NO. 40 in WO2016112870 |
| RAS | scFv | 6489 | SEQ ID NO. 81 in WO2016154047 |
| Rituximab | scFv | 6490 | SEQ ID NO. 36 in US20160208021 |
| Rituximab | scFv | 6491 | SEQ ID NO. 36 in WO2016112870 |
| RORI | scFv | 6492 | SEQ ID NO. 34 in EP3083691A2 |
| RORI | scFv | 6493 | SEQ ID NO. 249 in US20160208018A1 |
| RORI | scFv | 6494 | SEQ ID NO. 250 in US20160208018A1 |
| RORI | scFv | 6495 | SEQ ID NO. 251 in US20160208018A1 |
| RORI | scFv | 6496 | SEQ ID NO. 252 in US20160208018A1 |
| RORI | scFv | 6497 | SEQ ID NO. 253 in US20160208018A1 |
| RORI | scFv | 6498 | SEQ ID NO. 254 in US20160208018A1 |
| RORI | scFv | 6499 | SEQ ID NO. 255 in US20160208018A1 |
| RORI | scFv | 6500 | SEQ ID NO. 256 in US20160208018A1 |
| RORI | scFv | 6501 | SEQ ID NO. 257 in US20160208018A1 |
| RORI | scFv | 6502 | SEQ ID NO. 258 in US20160208018A1 |
| RORI | scFv | 6503 | SEQ ID NO. 259 in US20160208018A1 |
| RORI | scFv | 6504 | SEQ ID NO. 260 in US20160208018A1 |
| RORI | scFv | 6505 | SEQ ID NO. 261 in US20160208018A1 |
| RORI | scFv | 6506 | SEQ ID NO. 262 in US20160208018A1 |
| RORI | scFv | 6507 | SEQ ID NO. 263 in US20160208018A1 |
| RORI | scFv | 6508 | SEQ ID NO. 264 in US20160208018A1 |
| RORI | scFv | 6509 | SEQ ID NO. 265 in US20160208018A1 |
| RORI | scFv | 6510 | SEQ ID NO. 266 in US20160208018A1 |
| RORI | scFv | 6511 | SEQ ID NO. 267 in US20160208018A1 |
| RORI | scFv | 6512 | SEQ ID NO. 268 in US20160208018A1 |
| RORI | scFv | 6513 | SEQ ID NO. 57 in EP3083671A1 |
| RORI | scFv | 6514 | SEQ ID NO. 1 in US20160304619A1 |
| RORI | scFv | 6515 | SEQ ID NO. 2 in US20160304619A1 |
| RORI | scFv | 6516 | SEQ ID NO. 34 in WO2015092024A2 |
| Teplizumab | scFv | 6517 | SEQ ID NO. 42 in WO2016112870 |
| Teplizumab(mutated) | scFv | 6518 | SEQ ID NO. 42 in US20160208021 |
| TOSO | scFv | 6519 | SEQ ID NO. 2 in EP3098237A1 |
| Trastuzumab | scFv | 6520 | SEQ ID NO. 35 in US20160208021 |
| Trastuzumab | scFv | 6521 | SEQ ID NO. 35 in WO2016112870 |
| TRBC1 | scFv | 6522 | SEQ ID NO. 13 in WO2015132598 |
| TRBC1 | scFv | 6523 | SEQ ID NO. 14 in WO2015132598 |
| TRBC1 | scFv | 6524 | SEQ ID NO. 15 in WO2015132598 |
| TRBC1 | scFv | 6525 | SEQ ID NO. 16 in WO2015132598 |
| TRBC1 | scFv | 6526 | SEQ ID NO. 17 in WO2015132598 |
| TRBC1 | scFv | 6527 | SEQ ID NO. 18 in WO2015132598 |
| TRBC1 | scFv | 6528 | SEQ ID NO. 19 in WO2015132598 |
| TRBC1 | scFv | 6529 | SEQ ID NO. 20 in WO2015132598 |
| TRBC1 | scFv | 6530 | SEQ ID NO. 21 in WO2015132598 |
| TRBC1 | scFv | 6531 | SEQ ID NO. 22 in WO2015132598 |
| TRBC1 | scFv | 6532 | SEQ ID NO. 3 in WO2015132598 |
| TRBC2 | scFv | 6533 | SEQ ID NO. 23 in WO2015132598 |
| TRBC2 | scFv | 6534 | SEQ ID NO. 24 in WO2015132598 |
| TRBC2 | scFv | 6535 | SEQ ID NO. 25 in WO2015132598 |
| TRBC2 | scFv | 6536 | SEQ ID NO. 26 in WO2015132598 |
| TRBC2 | scFv | 6537 | SEQ ID NO. 27 in WO2015132598 |
| TRBC2 | scFv | 6538 | SEQ ID NO. 28 in WO2015132598 |

TABLE 11-continued scFv sequences

| Target | Description | SEQ ID NO | Source |
|---|---|---|---|
| TRBC2 | scFv | 6539 | SEQ ID NO. 29 in WO2015132598 |
| TRBC2 | scFv | 6540 | SEQ ID NO. 30 in WO2015132598 |
| TRBC2 | scFv | 6541 | SEQ ID NO. 31 in WO2015132598 |
| TRBC2 | scFv | 6542 | SEQ ID NO. 32 in WO2015132598 |
| TSLPR | scFv | 6543 | SEQ ID NO. 1 in US20160311910A1 |
| TSLPR | scFv | 6544 | SEQ ID NO. 2 in US20160311910A1 |
| TSLPR | scFv | 6545 | SEQ ID NO. 1 in WO2015084513 |
| TSLPR | scFv | 6546 | SEQ ID NO. 2 in WO2015084513 |
| VEGF | scFv | 6547 | SEQ ID NO. 168 in US20160090427 |
| VEGF | scFv | 6548 | SEQ ID NO. 169 in US20160090427 |
| VEGF | scFv | 6549 | SEQ ID NO. 170 in US20160090427 |
| VEGF | scFv | 6550 | SEQ ID NO. 171 in US20160090427 |
| VEGF | scFv | 6551 | SEQ ID NO. 172 in US20160090427 |
| VEGF | scFv | 6552 | SEQ ID NO. 173 US20160090427 |
| VEGF | scFv | 6553 | SEQ ID NO. 174 in US20160090427 |
| VEGF | scFv | 6554 | SEQ ID NO. 175 in US20160090427 |
| VEGFR | scFv | 6555 | SEQ ID NO. 498 in US20110177074A1 |
| VEGFR | scFv | 6556 | SEQ ID NO. 500 in US20110177074A1 |
| VEGFR | scFv | 6557 | SEQ ID NO. 502 in US20110177074A1 |
| VEGFR | scFv | 6558 | SEQ ID NO. 504 in US20110177074A1 |
| VEGFR | scFv | 6559 | SEQ ID NO. 506 in US20110177074A1 |
| VEGFR | scFv | 6560 | SEQ ID NO. 508 in US20110177074A1 |
| VEGFR2 | scFv | 6561 | SEQ ID NO. 1 in US20120213783 |
| VEGFR2 | scFv | 6562 | SEQ ID NO. 2 in US20120213783 |
| WT1/HLA Bispecific | scFv | 6563 | SEQ ID NO. 108 in WO2015070061 |
| WT1/HLA Bispecific | scFv | 6564 | SEQ ID NO. 113 in WO2015070061 |
| WT1/HLA Bispecific | scFv | 6565 | SEQ ID NO. 18 in WO2015070061 |
| WT1/HLA Bispecific | scFv | 6566 | SEQ ID NO. 36 in WO2015070061 |
| WT1/HLA Bispecific | scFv | 6567 | SEQ ID NO. 54 in WO2015070061 |
| WT1/HLA Bispecific | scFv | 6568 | SEQ ID NO. 72 in WO2015070061 |
| WT1/HLA Bispecific | scFv | 6569 | SEQ ID NO. 90 in WO2015070061 |
| αfolate receptor(FRα) | scFv | 6570 | SEQ ID NO. 15 in WO2012099973 |
| αfolate receptor(FRα) | scFv | 6571 | SEQ ID NO. 23 in WO2012099973 |

In one embodiment, the targeting moiety of the CAR may recognize CD19. CD19 is a well-known B cell surface molecule, which upon B cell receptor activation enhances B-cell antigen receptor induced signaling and expansion of B cell populations. CD19 is broadly expressed in both normal and neoplastic B cells. Malignancies derived from B cells such as chronic lymphocytic leukemia, acute lymphocytic leukemia and many non-Hodgkin lymphomas frequently retain CD19 expression. This near universal expression and specificity for a single cell lineage has made CD19 an attractive target for immunotherapies. Human CD19 has 14 exons wherein exon 1-4 encode the extracellular portion of the CD19, exon 5 encodes the transmembrane portion of CD19 and exons 6-14 encode the cytoplasmic tail. In one embodiment, the targeting moiety may comprise scFvs derived from the variable regions of the FMC63 antibody. FMC63 is an IgG2a mouse monoclonal antibody clone specific to the CD19 antigen that reacts with CD19 antigen on cells of the B lineage. The epitope of CD19 recognized by the FMC63 antibody is in exon 2 (Sotillo et al (2015) Cancer Discov; 5(12): 1282-95; the contents of which are incorporated by reference in their entirety). In some embodiments, the targeting moiety of the CAR may be derived from the variable regions of other CD19 monoclonal antibody clones including but not limited to 4G7, SJ25C1, CVID3/429, CVID3/155, HIB19, and J3-119.

In some embodiments, the targeting moiety of a CAR may recognize a tumor specific antigen (TSA), for example a cancer neoantigen that is only expressed by tumor cells because of genetic mutations or alterations in transcription which alter protein coding sequences, therefore creating novel, foreign antigens. The genetic changes result from genetic substitution, insertion, deletion or any other genetic changes of a native cognate protein (i.e. a molecule that is expressed in normal cells). In the context of CD19, TSAs may include a transcript variant of human CD19 lacking exon 2 or lacking exon 5-6 or both (see International patent publication No. WO2016061368; the contents of which are incorporated herein by reference in their entirety). Since FMC63 binding epitope is in exon 2, CD19 lacking exon 2 is not recognized by FMC63 antibody. Thus, in some embodiments, the targeting moiety of the CAR may be an FMC63-distinct scFV. As used herein "FMC63-distinct" refers, to an antibody, scFv or a fragment thereof that is immunologically specific and binds to an epitope of the CD19 antigen that is different or unlike the epitope of CD19 antigen that is bound by FMC63. In some instances, targeting moiety may recognize a CD19 antigen lacking exon2. In one embodiment, the targeting moiety recognizes a fragment of CD19 encoded by exon 1, 3 and/or 4. In one example, the targeting moiety recognizes the epitope that bridges the portion of CD19 encoded by exon 1 and the portion of CD19 encoded by exon 3.

Intracellular Signaling Domains

The intracellular domain of a CAR fusion polypeptide, after binding to its target molecule, transmits a signal to the immune effector cell, activating at least one of the normal effector functions of immune effector cells, including cytolytic activity (e.g., cytokine secretion) or helper activity. Therefore, the intracellular domain comprises an "intracellular signaling domain" of a T cell receptor (TCR).

In some aspects, the entire intracellular signaling domain can be employed. In other aspects, a truncated portion of the intracellular signaling domain may be used in place of the intact chain as long as it transduces the effector function signal.

In some embodiments, the intracellular signaling domain of the present invention may contain signaling motifs which are known as immunoreceptor tyrosine-based activation motifs (ITAMs). Examples of ITAM containing cytoplasmic signaling sequences include those derived from TCR CD3zeta, FcR gamma, FcR beta, CD3 gamma, CD3 delta, CD3 epsilon, CD5, CD22, CD79a, CD79b, and CD66d. In one example, the intracellular signaling domain is a CD3 zeta (CD3ζ) signaling domain.

In some embodiments, the intracellular region of the present invention further comprises one or more costimulatory signaling domains which provide additional signals to the immune effector cells. These costimulatory signaling domains, in combination with the signaling domain can further improve expansion, activation, memory, persistence, and tumor-eradicating efficiency of CAR engineered immune cells (e.g., CAR T cells). In some cases, the costimulatory signaling region contains 1, 2, 3, or 4 cytoplasmic domains of one or more intracellular signaling and/or costimulatory molecules. The costimulatory signaling domain may be the intracellular/cytoplasmic domain of a costimulatory molecule, including but not limited to CD2, CD7, CD27, CD28, 4-1BB (CD137), OX40 (CD134), CD30, CD40, ICOS (CD278), GITR (glucocorticoid-induced tumor necrosis factor receptor), LFA-1 (lymphocyte function-associated antigen-1), LIGHT, NKG2C, B7-H3. In one example, the costimulatory signaling domain is derived from the cytoplasmic domain of CD28. In another example, the costimulatory signaling domain is derived from the cytoplasmic domain of 4-1BB (CD137). In another example, the co-stimulatory signaling domain may be an intracellular domain of GITR as taught in U.S. Pat. No. 9,175,308; the contents of which are incorporated herein by reference in its entirety.

In some embodiments, the intracellular region of the present invention may comprise a functional signaling domain from a protein selected from the group consisting of an MHC class I molecule, a TNF receptor protein, an immunoglobulin-like protein, a cytokine receptor, an integrin, a signaling lymphocytic activation protein (SLAM) such as CD48, CD229, 2B4, CD84, NTB-A, CRACC, BLAME, CD2F-10, SLAMF6, SLAMF7, an activating NK cell receptor, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), SLAMF7, NKp80 (KLRF1), NKp44, NKp30, NKp46, CD19, CD4, CD8alpha, CD8beta, IL2R beta, IL2R gamma, IL7R alpha, IL15Ra, ITGA4, VLA1, CD49a, ITGA4, IA4, CD49D, ITGA6, VLA-6, CD49f, ITGAD, CD11 d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, NKD2C SLP76, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, CD270 (HVEM), GADS, SLP-76, PAG/Cbp, CD19a, a ligand that specifically binds with CD83, DAP 10, TRIM, ZAP70, Killer immunoglobulin receptors (KIRs) such as KIR2DL1, KIR2DL2/L3, KIR2DL4, KIR2DL5A, KIR2DL5B, KIR2DS1, KIR2DS2, KIR2DS3, KIR2DS4, KIR2DS5, KIR3DL1/S1, KIR3DL2, KIR3DL3, and KIR2DP 1; lectin related NK cell receptors such as Ly49, Ly49A, and Ly49C.

In some embodiments, the intracellular signaling domain of the present invention may contain signaling domains derived from JAK-STAT. In other embodiments, the intracellular signaling domain of the present invention may contain signaling domains derived from DAP-12 (Death associated protein 12) (Topfer et al., *Immunol.*, 2015, 194: 3201-3212; and Wang et al., Cancer Immunol., 2015, 3: 815-826). DAP-12 is a key signal transduction receptor in NK cells. The activating signals mediated by DAP-12 play important roles in triggering NK cell cytotoxicity responses toward certain tumor cells and virally infected cells. The cytoplasmic domain of DAP12 contains an Immunoreceptor Tyrosine-based Activation Motif (ITAM). Accordingly, a CAR containing a DAP 12-derived signaling domain may be used for adoptive transfer of NK cells.

In some embodiments, T cells engineered with two or more CARs incorporating distinct co-stimulatory domains and regulated by distinct DD may be used to provide kinetic control of downstream signaling.

In some embodiments, the payload of the invention may be any of the co-stimulatory molecules and/or intracellular domains described herein. In some embodiments, one or more co-stimulatory molecules, each under the control of different SRE may be used in the present invention. SRE regulated co-stimulatory molecules may also be expressed in conjunction with a first-generation CAR, a second-generation CAR, a third-generation CAR, a fourth-generation, or any other CAR design described herein.

In some embodiments, the intracellular domain of the present invention may comprise amino acid sequences of Table 12.

TABLE 12

Intracellular signaling and co-stimulatory domains

| Domain | Amino Acid Sequence | SEQ ID NO. |
|---|---|---|
| 2B4 co-stimulatory domain | WRRKRKEKQSETSPKEFLTIYEDVKDLKTRRNHEQEQTF PGGGSTIYSMIQSQSSAPTSQEPAYTLYSLIQPSRKSGSRK RNHSPSFNSTIYEVIGKSQPKAQNPARLSRKELENFDVYS | 6572 |
| CD27 co-stimulatory domain | HQRRKYRSNKGESPVEPAEPCRYSCPREEEGSTIPIQEDY RKPEPACSP | 6573 |
| CD272 (BTLA1) co-stimulatory domain | RRHQGKQNELSDTAGREINLVDAKLKSEQTEASTRQNSQ VLLSETGIYDNDPDLCFRMQEGSEVYSNPCLEENKPGIVY ASLNHSVIGPNSRLARNVKEAPIEYASICVRS | 6574 |

TABLE 12-continued

Intracellular signaling and co-stimulatory domains

| Domain | Amino Acid Sequence | SEQ ID NO. |
|---|---|---|
| CD272 (BTLA1) co-stimulatory domain | CCLRRHQGKQNELSDTAGREINLVDAHLKSEQTEASTRQ NSQVLLSETGIYDNDPDLCFRMQEGSEVYSNPCLEENKP GIVYASLNHSVIGPNSRLARNVKEAPIEYASICVRS | 6575 |
| CD28 co-stimulatory | FWVLVVVGGVLACYSLLVTVAFIIFWV | 6576 |
| CD28 co-stimulatory domain | KRGRKKLLYIFKQPFMRPVQTTQEEDGCSCRFPEEEEGG CEL | 6577 |
| CD28 co-stimulatory domain | FWVRSKRSRLLHSDYMNMTPRRPGPTRKHYQPYAPPRD FAAYRS | 6578 |
| CD28 co-stimulatory domain | RSKRSRGGHSDYMNMTPRRPGPTRKHYQPYAPPRDFAA YRS | 6579 |
| CD28 co-stimulatory domain | RSKRSRGGHSDYIVINMTPRRPGPTRKHYQPYAPPRDFA AYRS | 6580 |
| CD28 co-stimulatory signaling region | MLRLLLALNLFPSIQVTGNKILVKQSPMLVAYDNAVNLS CKYSYNLFSREFRASLHKGLDSAVEVCVVYGNYSQQLQ VYSKTGFNCDGKLGNESVTFYLQNLYVNQTDIYFCKIEV MYPPPYLDNEKSNGTIIHVKGKHLCPSPLFPGPSKPFWVL VVVGGVLACYSLLVTVAFIIFWVRSKRSRLLHSDYMNM TPRRPGPTRKHYQPYAPPRDFAAYRS | 6581 |
| CD30 co-stimulatory domain | RRACRKRIRQKLHLCYPVQTSQPKLELVDSRPRRSSTQLR SGASVTEPVAEERGLMSQPLMETCHSVGAAYLESLPLQD ASPAGGPSSPRDLPEPRVSTEHTNNKIEKIYIMKADTVIVG TVKAELPEGRGLAGPAEPELEEELEADHTPHYPEQEIEPP LGSCSDVMLSVEEEGKEDPLPTAASGK | 6582 |
| CD30 co-stimulatory domain | RRACRKRIRQKLHLCYPVQTSQPKLELVDSRPRRSSTQLR SGASVTEPVAEERGLMSQPLMETCHSVGAAYLESLPLQD ASPAGGPSSPRDLPEPRVSTEHTNNKIEKIYIMKADTVIVG TVKAELPEGRGLAGPAEPELEEELEADHTPHYPEQETEPP LGSCSDVMLSVEEEGKEDPLPTAASGK | 6583 |
| GITR co-stimulatory domain | HIWQLRSQCMWPRETQLLLEVPPSTEDARSCQFPEEERG ERSAEEKGRLGDLWV | 6584 |
| HVEM co-stimulatory domain | CVKRRKPRGDVVKVIVSVQRKRQEAEGEATVIEALQAPP DVTTVAVEETIPSFTGRSPNH | 6585 |
| ICOS co-stimulatory domain | TKKKYSSSVHDPNGEYMFMRAVNTAKKSRLTDVTL | 6586 |
| ICOS co-stimulatory signaling domain | CWLTKKKYSSSVHDPNGEYMFMRAVNTAKKSRLTDVT L | 6587 |
| LAG-3 co-stimulatory region | HLWRRQWRPRRFSALEQGIHPPQAQSKIEELEQEPEPEPE PEPEPEPEPEPEQL | 6588 |
| OX40 co-stimulatory domain | ALYLLRRDQRLPPDAHKPPGGGSFRTPIQEEQADAHSTL AKI | 6589 |
| OX40 co-stimulatory domain | RRDQRLPPDAHKPPGGGSFRTPIQEEQADAHSTLAKI | 6590 |
| 4-1BB intracellular domain | KRGRKKLLYIFKQPFMRPVQTIQEEDGCSCRFPEEEEGGC EL | 6591 |
| 4-1BB signaling domain | KRGRKKLLYIFKQPFMRPVQTTQEEDGCSCRFPEEEEGG YEL | 6592 |
| 4-1BB-CD3Zeta intracellular domain | TGTTTPAPRPPTPAPTIASQPLSLRPEACRPAAGGAVHTR GLDFACDIYIWAPLAGTCGVLLLSLVITLYCKRGRKKLL YIFKQPFMRPVQTTQEEDGCSCRFPEEEEGGCELRVKFSR SADAPAYQQGQNQLYNELNLGRREEYDVLDKRRGRDPE MGGKPRRKNPQEGLYNELQKDKMAEAYSEIGMKGERR RGKGHDGLYQGLSTATKDTYDALHMQALPPR | 6593 |
| 4-1BB-Z endodomain fusion | KRGRKKLLYIFKQPFMRPVQTTQEEDGCSCRFPEEEEGG CELRVKFSRSADAPAYQQGQNQLYNELNLGRREEYDVL DKRRGRDPEMGGKPRRKNPQEGLYNELQKDKMAEAYS EIGMKGERRRGKGHDGLYQGLSTATKDTYDALHMQALP PR | 6594 |

TABLE 12-continued

Intracellular signaling and co-stimulatory domains

| Domain | Amino Acid Sequence | SEQ ID NO. |
|---|---|---|
| CD127 intracellular domain | KRIKPIVWPSLPDHKKTLEHLCKKPRKNLNVSFNPESFLD CQIHRVDDIQARDEVEGFLQDTFPQQLEESEKQRLGGDV QSPNCPSEDVVITPESFGRDSSLTCLAGNVSACDAPILSSS RSLDCRESGKNGPHVYQDLLLSLGTTNSTLPPPFSLQSGIL TLNPVAQGQPILTSLGSNQEEAYVTMSSFYQNQ | 6595 |
| CD137 intracellular domain | RFSVVKRGRKKLLYIFKQPFMRPVQTTQEEDGCSCRFPEE EEGGCEL | 6596 |
| CD148 intracellular domain | RKKRKDAKNNEVSFSQIKPKKSKLIRVENFEAYFKKQQA DSNCGFAEEYEDLKLVGISQPKYAAELAENRGKNRYNN VLPYDISRVKLSVQTHSTDDYINANYMPGYHSKKDFIAT QGPLPNTLKDFWRMVWEKNVYAIIMLTKCVEQGRTKCE EYWPSKQAQDYGDITVAMTSEIVLPEWTIRDFTVKNIQTS ESHPLRQFHFTSWPDHGVPDTTDLLINFRYLVRDYMKQS PPESPILVHCSAGVGRTGTFIAIDRLIYQIENENTVDVYGI VYDLRMHRPLMVQTEDQYVFLNQCVLDIVRSQKDSKVD LIYQNTTAMTIYENLAPVTTFGKTNGYIA | 6597 |
| CD27 intracellular domain | QRRKYRSNKGESPVEPAEPCHYSCPREEEGSTIPIQEDYR KPEPACSP | 6598 |
| CD28 intracellular domain | FAAYRS | 6599 |
| CD28 signaling chain | FWVLVVVGGVLACYSLLVTVAFBFWVRSKRSRLLHSDY MNMTPRRPGPTRKHYQPYAPPRDFAAYRS | 6600 |
| CD28 signaling domain | RSKRSRLLHSDYMNMTPRRPGPTRKHYQPYAPPRDFAA YRS | 6601 |
| CD28 signaling domain | SKRSRLLHSDYMNMTPRRPGPTRKHYQPYAPPRDFAAY RS | 6602 |
| CD28 signaling domain | IEVMYPPPYLDNEKSNGTIIHVKGKHLCPSPLFPGPSKPF WVLVVVGGVLACYSLLVTVAFIIFWRSKRSRLLHSDYM NMTPRRPGPTRKHYQPYAPPRDFAAYRS | 6603 |
| CD28, 4-1BB, and/or CD3ζ signaling domain | RSKRSRLLHSDYMNMTPRRPGPTRKHYQPYAPPRDFAA YRSRFSVVKRGRKKLLYIFKQPFMRPVQTTQEEDGCSCR FPEEEEGGCELRVKFSRSADAPAYQQGQNQLYNELNLGR REEYDVLDKRRGRDPEMGGKPRRKNPQEGLYNELQKDK MAEAYSEIGMKGERRRGKGHDGLYQGLSTATKDTYDAL HMQALPPR | 6604 |
| CD28/CD3C | AAAIEVMYPPPYLDNEKSNGTIIHVKGKHLCPSPLFPGPS KPFWVLVVVGGVLACYSLLVTVAFIIFWVRSKRSRLLHS DYMNMTPRRPGPTRKHYQPYAPPRDFAAYRSRVKFSRS ADAPAYQQGQNQLYNELNLGRREEYDVLDKRRGRDPE MGGKPRRKNPQEGLYNELQKDKMAEAYSEIGMKGERR RGKGHDGLYQGLSTATKDTYDALHMQALPPR | 6605 |
| CD28-0XZ intracellular domain | RSKRSRLLHSDYNMTPRRPGPTRKHYQPYAPPRDFAAYR SRDQRLPPDAHKPPGGGSFRTPIQEEQADAHSTLAKIRVK FSRSADAPAYQQGQNQLYNELNLGRREEYDVLDKRRGR DPEMGGKPRRKNPQEGLYNELQKDKMAEAYSEIGMKGE RRRGKGHDGLYQGLSTATKDTYDALHMQALPPR | 6606 |
| CD28-4-1BB intracellular domain | MFWVLVVVGGVLACYSLLVTVAFIIFWVKRGRKKLLYIF KQPFMRPVQTTQEEDGCSCRFPEEEEGGCEL | 6607 |
| CD28-4-1BB intracellular domain | IEVMYPPPYLDNEKSNGTIIHVKGKHLCPSPLFPGPSKPF WVLVVVGGVLACYSLLVTVAFIIFWVKRGRKKLLYIFKQ PFMRPVQTTQEEDGCSCRFPEEEEGGCEL | 6608 |
| CD28-CD3Zeta intracellular domain | RSKRSRLLHSDYMNMTPRRPGPTRKHYQPYAPPRDFAA YRSRVKFSRSADAPAYQQGQNQLYNELNLGRREEYDVL DKRRGRDPEMGGKPRRKNPQEGLYNELQKDKMAEAYS EIGMKGERRRGKGHDGLYQGLSTATKDTYDALHMQALP PR | 6609 |
| CD28-CD3Zeta intracellular domain | KRSRLLHSDYMNMTPRRPGPTRKHYQPYAPPRDFAAYR SRVKFSRSADAPAYQQGQNQLYNELNLGRREEYDVLDK RRGRDPEMGGKPRRKNPQEGLYNELQKDKMAEAYSEIG MKGERRRGKGHDGLYQGLSTATKDTYDALHMQALPPR | 6610 |

TABLE 12-continued

Intracellular signaling and co-stimulatory domains

| Domain | Amino Acid Sequence | SEQ ID NO. |
|---|---|---|
| CD3 delta chain intracellular signaling domain | MEHSTFLSGLVLATLLSQVSPFKIPIEELEDRVFVNCNTSI TWVEGTVGTLLSDITRLDLGKRILDPRGIYRCNGTDIYKD KESTVQVHYRMCQSCVELDPATVAGIIVTDVIATLLLAL GVFCFAGHETGRLSGAADTQALLRNDQVYQPLRDRDDA QYSHLGGNWARNK | 6611 |
| CD3 delta chain intracellular signaling domain | MEHSTFLSGLVLATLLSQVSPFKIPIEELEDRVFVNCNTSI TWVEGTVGTLLSDITRLDLGKRILDPRGIYRCNGTDIYKD KESTVQVHYRTADTQALLRNDQVYQPLRDRDDAQYSHL GGNWARNK | 6612 |
| CD3 delta chain intracellular signaling domain | DQVYQPLRDRDDAQYSHLGGN | 6613 |
| CD3 delta intracellular domain | MEHSTFLSGLVLATLLSQVSPFKIPIEELEDRVFVNCNTSI TWVEGTVGTLLSDITRLDLGKRILDPRGIYRCNGTDIYKD KESTVQVHYRMCQSCVELDPATVAGIIVTDVIATLLLAL GVFCFAGHETGRLSGAADTQALLRNDQVYQPLRDRDDA QYSHLGGNWARNK | 6614 |
| CD3 delta intracellular domain | MEHSTFLSGLVLATLLSQVSPFKIPIEELEDRVFVNCNTSI TWVEGTVGTLLSDITRLDLGKRILDPRGIYRCNGTDIYKD KESTVQVHYRTADTQALLRNDQVYQPLRDRDDAQYSHL GGNWARNK | 6615 |
| CD3 delta intracellular domain | DQVYQPLRDRDDAQYSHLGGN | 6616 |
| CD3 epsilon intracellular domain | MQSGTHWRVLGLCLLSVGVWGQDGNEEMGGITQTPYK VSISGTTVILTCPQYPGSEILWQHNDKNIGGDEDDKNIGS DEDHLSLKEFSELEQSGYYVCYPRGSKPEDANFYLYLRA RVCENCMEMDVMSVATIVIVDICITGGLLLLVYYWSKNR KAKAKPVTRGAGAGGRQRGQNKERPPPVPNPDYEPIRK GQRDLYSGLNQRRI | 6617 |
| CD3 epsilon intracellular domain | NPDYEPIRKGQRDLYSGLNQR | 6618 |
| CD3 gamma intracellular domain | MEQGKGLAVLILAIILLQGTLAQSIKGNHLVKVYDYQED GSVLLTCDAEAKNITWFKDGKMIGFLTEDKKKWNLGSN AKDPRGMYQCKGSQNKSKPLQVYYRMCQNCIELNAATI SGFLFAEIVSIFVLAVGVYFIAGQDGVRQSRASDKQTLLP NDQLYQPLKDREDDQYSHLQGNQLRRN | 6619 |
| CD3 gamma intracellular domain | DQLYQPLKDREDDQYSHLQGN | 6620 |
| CD3 gamma intracellular domain | DQLYQPLKDREDDQYSHLQGN | 6621 |
| CD3 gamma intracellular domain | MEQGKGLAVLILAIILLQGTLAQSIKGNHLVKVYDYQED GSVLLTCDAEAKNITWFKDGKMIGFLTEDKKKWNLGSN AKDPRGMYQCKGSQNKSKPLQVYYRMCQNCIELNAATI SGFLFAEIVSIFVLAVGVYFIAGQDGVRQSRASDKQTLLP NDQLYQPLKDREDDQYSHLQGNQLRRN | 6622 |
| CD3 zeta intracellular domain | MKWKALFTAAILQAQLPITEAQSFGLLDPKLCYLLDGILF IYGVILTALFLRVKFSRSADAPAYQQGQNQLYNELNLGR REEYDVLDKRRGRDPEMGGKPRRKNPQEGLYNELQKDK MAEAYSEIGMKGERRRGKGHDGLYQGLSTATKDTYDAL HMQALPPR | 6623 |
| CD3 zeta intracellular domain | MKWKALFTAAILQAQLPITEAQSFGLLDPKLCYLLDGILF IYGVILTALFLRVKFSRSADAPAYQQGQNQLYNELNLGR REEYDVLDKRRGRDPEMGGKPQRRKNPQEGLYNELQKD KMAEAYSEIGMKGERRRGKGHDGLYQGLSTATKDTYD ALHMQALPPR | 6624 |
| CD3 zeta intracellular domain | MKWKALFTAAILQAQLPITEAQSFGLLDPKLCYLLDGILF IYGVILTALFLRVKFSRSADAPAYQQGQNQLYNELNLGR REEYDVLDKRRGRDPEMGGKPQRRKNPQEGLYNELQKD KMAEAYSEIGMKGERRRGKGHDGLYQGLSTATKDTYD ALHMQALPPR | 6625 |

TABLE 12-continued

Intracellular signaling and co-stimulatory domains

| Domain | Amino Acid Sequence | SEQ ID NO. |
|---|---|---|
| CD3 zeta inttacellular domain | NQLYNELNLGRREEYDVLDKR | 6626 |
| CD3 zeta domain 2 (NM_000734.3) | RVKFSRSADAPAYQQGQNQLYNELNLGRREEYDVLDKR RGRDPEMGGKPRRKNPQEGLYNELQKDKMAEAYSEIGM KGERRRGKGHDGLYQGLSTATKDTYDALHMQALPPR | 6627 |
| CD3 zeta intracellular domain | DGLYQGLSTATKDTYDALHMQ | 6628 |
| CD3 zeta intracellular domain | RVKFSRSAEPPAYQQGQNQLYNELNLGRREEYDVLDKR RGRDPEMGGKPRRKNPQEGLYNELQKDKMAEAYSEIGM KGERRRGKGHDGLYQGLSTATKDTYDALHMQALPPR | 6629 |
| CD3 zeta intracellular domain | RVKFSRSADAPAYQQGQNQLYNELNLGRREEYDVLDKR RGRDPEMGGKPQRRKNPQEGLYNELQKDKMAEAYSEIG MKGERRRGKGHDGLYQGLSTATKDTYDALHMQALPPR | 6630 |
| CD3 zeta intracellular domain | RSRVKFSRSADAPAYQQGQNQLYNELNLGRREEYDVLD KRRGRDPEMGGKPRRKNPQEGLYNELQKDKMAEAYSEI GMKGERRRGKGHDGLYQGLSTATKDTYDALHMQALPP R | 6631 |
| CD3 zeta intracellular domain | RVKFSRSADAPAYQQGEYDVLDKRRGRDPEMGGKPRRK NPQEGLYNELQKDKMAEAYSEIGMKGERRRGKGHDGL YQGLSTATKDTYDALHMQALPPR | 6632 |
| CD3 zeta intracellular domain | RVKFSRSADAPAYQQGQNQLYNELNLGRREEVDVLDKR RGRDPEMGGKPRRKNPQEGLYNELQKDKMAEAYSEIGM KGERRRGKGHDGLYQGLSTATKDTYDALHMQALPPR | 6633 |
| CD3 zeta intracellular domain | MIPAVVLLLLLLVEQAAALGEPQLCYILDAILFLVGIVLTL LVCRLKIQVRKAAITSYEKSRVKFSRSADAPAYQQGQNQ LYNELNLGRREEYDVLDKRRGRDPEMGGKPRRKNPQEG LYNELQKDKMAEAVSEIGMKGERRRGKGHDGLYQGLST ATKDTYDALHMQALPPR | 6634 |
| CD3 zeta intracellular domain | LRVKFSRSADAPAYQQGQNQLYNELNLGRREEYDVLDK RRGRDPEMGGKPRRKNPQEGLYNELQKDKMAEAYSEIG MKGERRRGKGHDGLYQGLSTATKDTYDALHMQALPPR | 6635 |
| CD3 zeta intracellular domain | RVKFSRSADAPAYQQGQNQLYNELNLGRREEYDVLDKR RGRDPEMGGKPQRRKNPQEGLY | 6636 |
| CD3 zeta intracellular domain | LRVKFSRSADAPAYQQGQNQLYNELNLGRREEYDVLDK RRGRDPEMGGKPQRRKNPQEGLYNELQKDKMAEAYSEI GMKGERRRGKGHDGLYQGLSTATKDTYDALHMQALPP R | 6637 |
| CD3 zeta intracellular domain | RRVKFSRSADAPAYQQGQNQLYNELNLGRREEYDVLDK RRGRDPEMGGKPRRKNPQEGLYNELQKDKMAEAYSEIG MKGERRRGKGHDGLYQGLSTATKDTYDALHMQALPPR | 6638 |
| CD3 zeta intracellular domain | NQLYNELNLGRREEYDVLDKR | 6639 |
| CD3 zeta intracellular domain | EGLYNELQKDKMAEAYSEIGMK | 6640 |
| CD3 zeta intracellular domain | DGLYQGLSTATKDTYDALHMQ | 6641 |
| CD3 zeta intracellular domain | RVKFSRSADAPAYQQGQNQLYNELNLGRREEYDVLDKR RGRDPEMGGKPRRKNPQEGLYNELQKDKMAEAYSEIGM KGERRRGKGHDGLYQGLSTATKDTYDALHMQALPPR | 6642 |
| CD3 zeta intracellular domain | RVKFSRSADAPAYKQGQNQLYNELNLGRREEYDVLDKR RGRDPEMGGKPRRKNPQEGLYNELQKDKMAEAYSEIGM KGERRRGKGHDGLYQGLSTATKDTYDALHMQALPPR | 6643 |
| CD3 zeta intracellular domain | RVKFSRSADAPAYQQGQNQLYNELNLGRREEYDVLDKR RGRDPEMGGKPRRKNPQEGLYNELQKDKMAEAYSEIGM KGERRRGKGHDGLYQGLSTATKDTYDALHMQALP | 6644 |

TABLE 12-continued

Intracellular signaling and co-stimulatory domains

| Domain | Amino Acid Sequence | SEQ ID NO. |
|---|---|---|
| CD3 zeta intracellular domain | DPKLCYLLDGILFIYGVILTALFLRVKFSRSADAPAYQQG QNQLYNELNLGRREEYDVLDKRRGRDPEMGGKPQRRK NPQEGLYNELQKDKMAEAYSEIGMKGERRRGKGHDGL YQGLSTATKDTYDALHMQALPPR | 6645 |
| CD3 zeta intracellular domain | MKWKALFTAAILQAQLPITEAQSFGLLDPKLCYLLDGILF IYGVILTALFLRVKFSRSADAPAYQQGQNQLYNELNLGR REEYDVLDKRRGRDPEMGGKPRRKNPQEGLYNELQKDK MAEAYSEIGMKGERRRGKGHDGLYQGLSTATKDTYDAL HMQALPPR | 6646 |
| CD40 intracellular domain | RSRDQRLPPDAHKPPGGGSFRTPIQEEQADAHSTLAKI | 6647 |
| CD79A intracellular domain | MPGGPGVLQALPATIFLLFLLSAVYLGPGCQALWMHKV PASLMVSLGEDAHFQCPHNSSNNANVTWWRVLHGNYT WPPEFLGPGEDPNGTLIIQNVNKSHGGIYVCRVQEGNESY QQSCGTYLRVRQPPPRPFLDMGEGTKNRIITAEGIILLFCA VVPGTLLLFRKRWQNEKLGLDAGDEYEDENLYEGLNLD DCSMYEDISRGLQGTYQDVGSLNIGDVQLEKP | 6648 |
| CD79A intracellular domain | MPGGPGVLQALPATIFLLFLLSAVYLGPGCQALWMHKV PASLMVSLGEDAHFQCPHNSSNNANVTWWRVLHGNYT WPPEFLGPGEDPNEPPPRPFLDMGEGTKNRIITAEGIILLF CAVVPGTLLLFRKRWQNEKLGLDAGDEYEDENLYEGLN LDDCSMYEDISRGLQGTYQDVGSLNIGDVQLEKP | 6649 |
| CD79A intracellular domain | MPGGPGVLQALPATIFLLFLLSAVYLGPGCQALWMHKV PASLMVSLGEDAHFQCPHNSSNNANVTWWRVLHGNYT WPPEFLGPGEDPNGTLIIQNVNKSHGGIYVCRVQEGNESY QQSCGTYLRVRQPPPRPFLDMGEGTKNRIITAEGIILLFCA VVPGTLLLFRKRWQNEKLGLDAGDEYEDENLYEGLNLD DCSMYEDISRGLQGTYQDVGSLNIGDVQLEKP | 6650 |
| CD79A intracellular domain | ENLYEGLNLDDCSMYEDISRG | 6651 |
| CD8 intracellular domain | FVPVFLPAKPTTTPAPRPPTPAPTIASQPLSLRPEACRPAA GGAVHTRGLDFACDIYIWAPLAGTCGVLLLSLVITLYCN HRNR | 6652 |
| CD8 intracellular domain | FVPVFLPAKPITTPAPRPPTPAPTIASQPLSLRPEACRPAAG GAVHTRGLDFACDIYIWAPLAGTCGVLLLSLVITLYCNH RNR | 6653 |
| CD8a intracellular domain | PTTTPAPRPPTPAPTIASQPLSLRPEACRPAAGGAVHTRGL DFACDI | 6654 |
| CTLA4 intracellular domain | AVSLSKMLKKRSPLTTGVFVKMAPTEAECEKQFQPYFIPI N | 6655 |
| CTLA4 intracellular domain | AVSLSKMLKKRSPLTTGVYMNMTPRRPECEKQFQPYAPP RDFAAYRS | 6656 |
| DAP10 intracellular domain | RPRRSPAQDGKVYINMPGRG | 6657 |
| DAP12 intracellular domain | MGGLEPCSRLLLLPLLLAVSGLRPVQAQAQSDCSCSTVSP GVLAGIVMGDLVLTVLIALAVYFLGRLVPRGRGAAEAA TRKQRITETESPYQELQGQRSDVYSDLNTQRPYYK | 6658 |
| DAP12 intracellular domain | MGGLEPCSRLLLLPLLLAVSGLRPVQAQAQSDCSCSTVSP GVLAGIVMGDLVLTVLIALAVYFLGRLVPRGRGAAEATR KQRITETESPYQELQGQRSDVYSDLNTQRPYYK | 6659 |
| DAP12 intracellular domain | MGGLEPCSRLLLLPLLLAVSDCSCSTVSPGVLAGIVMGD LVLTVLIALAVYFLGRLVPRGRGAAEEAATRKQRITETESP YQELQGQRSDVYSDLNTQRPYYK | 6660 |
| DAP12 intracellular domain | MGGLEPCSRLLLLPLLLAVSDCSCSTVSPGVLAGIVMGD LVLTVLIALAVYFLGRLVPRGRGAAEATRKQRITETESPY QELQGQRSDVYSDLNTQRPYYK | 6661 |
| DAP12 intracellular domain | MGGLEPCSRLLLLPLLLAVSGLRPVQAQAQSDCSCSTVSP GVLAGIVMGDLVLTVLIALAVYFLGRLVPRGRGAAEAA TRKQRITETESPYQELQGQRSDVYSDLNTQRPYYK | 6662 |

TABLE 12-continued

Intracellular signaling and co-stimulatory domains

| Domain | Amino Acid Sequence | SEQ ID NO. |
|---|---|---|
| DAP12 intracellular domain | MGGLEPCSRLLLLPLLLAVSGLRPVQAQAQSDCSCSTVSP GVLAGIVMGDLVLTVLIALAVYFLGRLVPRGRGAAEATR KQRITETESPYQELQGQRSDVYSDLNTQRPYYK | 6663 |
| DAP12 intracellular domain | MGGLEPCSRLLLLPLLLAVSDCSCSTVSPGVLAGIVMGD LVLTVLIALAVYFLGRLVPRGRGAAEEATRKQRITETESP YQELQGQRSDVYSDLNTQRPYYK | 6664 |
| DAP12 intracellular domain | MGGLEPCSRLLLLPLLLAVSDCSCSTVSPGVLAGIVMGD LVLTVLIALAVYFLGRLVPRGRGAAEATRKQRITETESPY QELQGQRSDVYSDLNTQRPYYK | 6665 |
| DAP12 intracellular domain | ESPYQELQGQRSDVYSDLNTQ | 6666 |
| DAP12 intracellular domain | ESPYQELQGQRSDVYSDLNTQ | 6667 |
| GITR intracellular domain | RSQCMVVPRETQLLLEVPPSTEDARSCQFPEEERGERSAEE KGRLGDLWV | 6668 |
| ICOS intracellular domain | TKKKYSSSVHDPNGEFMFMRAVNTAKKSRLTDVTL | 6669 |
| IL15Ra intracellular domain | KSRQTPPLASVEMEAMEALPVTWGTSSRDEDLENCSHHL | 6670 |
| OX40-CD3 Zeta intracellular domain | RRDQRLPPDAHKPPGGGSFRTPIQEEQADAHSTLAKIRVK FSRSADAPAYQQGQNQLYNELNLGRREEYDVLDKRRGR DPEMGGKPRRKNPQEGLYNELQKDKMAEAYSEIGMKGE RRRGKGHDGLYQGLSTATKDTYDALHMQALPPR | 6671 |
| ZAP70 intracellular domain | MPDPAAHLPFFYGSISRAEAEEHLKLAGMADGLFLLRQC LRSLGGYVLSLVHDVRFHHFPIERQLNGTYAIAGGKAHC GPAELCEFYSRDPDGLPCNLRKPCNRPSGLEPQPGVFDCL RDAMVRDYVRQTWKLEGEALEQAIISQAPQVEKLIATTA HERMPWYHSSLTREEAERKLYSGAQTDGKFLLRPRKEQ GTYALSLIYGKTVYHYLISQDKAGKYCIPEGTKFDTLWQ LVEYLKLKADGLIYCLKEACPNSSASNASGAAAPTLPAH PSTLTHPQRRIDTLNSDGYTPEPARITSPDKPRPMPMDTS VYESPYSDPEELKDKKLFLKRDNLLIADIELGCGNFGSVR QGVYRMRKKQIDVAIKVLKQGTEKADTEEMMREAQIM HQLDNPYIVRLIGVCQAEALMLVMEMAGGGPLHKFLVG KREEIPVSNVAELLHQVSMGMKYLEEKNFVHRDLAARN VLLVNRHYAKISDFGLSKALGADDSYYTARSAGKWPLK WYAPECINFRKFSSRSDVWSYGVTMWEALSYGQKPYKK MKGPEVMAFIEQGKRMECPPECPPELYALMSDCWIYKW EDRPDFLTVEQRMRACYYSLASKVEGPPGSTQKAEAAC A | 6672 |
| CD28 intracellular domain | MLRLLLALNLFPSIQVTGNKILVKQSPMLVAYDNAVNLS CKYSYNLFSREFRASLHKGLDSAVEVCVVYGNYSQQLQ VYSKTGFNCDGKLGNESVTFYLQNLYVNQTDIYFCKIEV MYPPPYLDNEKSNGTIIHVKGKHLCPSPLFPGPSKPFWVL VVVGGVLACYSLLVTVAFIIFWVR | 6673 |
| 4-1BB intracellular domain | MGNSCYNIVATLLLVLNFERTRSLQDPCSNCPAGTFCDN NRNQICSPCPPNSFSSAGGQRTCDICRQCKGVFRTRKECS STSNAECDCTPGFHCLGAGCSMCEQDCKQGQELTKKGC KDCCFGTFNDQKRGICRPWTNCSLDGKSVLVNGTKERD VVCGPSPADLSPGASSVTPPAPAREPGHSPQIISFFLALTST ALLFLLFFLTLRFSVVKRGRKKLLYIFKQPFMRPVQTTQE EDG | 6674 |
| Fc epsilon Receptor I gamma chain intracellular domain | MIPAVVLLLLLLVEQAAALGEPQLCYILDAILFLYGIVLTL LYCRLKIQVRKAAITSYEKSDGVYTGLSTRNQETYETLK HEKPPQ | 6675 |
| Fc epsilon Receptor I gamma chain intracellular domain | DGVYTGLSTRNQETYETLKHE | 6676 |
| Fc epsilon Receptor I gamma chain intracellular domain | DPKLCYILDAILFLYGIVLTLLYCRLKIQVRKAAITSYEKS DGVYTGLSTRNQETYETLKHEKPPQ | 6677 |
| Fc epsilon Receptor I gamma chain intracellular domain | DGVYTGLSTRNQETYETLKHE | 6678 |

Transmembrane Domains

In some embodiments, the CAR of the present invention may comprise a transmembrane domain. As used herein, the term "Transmembrane domain (TM)" refers broadly to an amino acid sequence of about 15 residues in length which spans the plasma membrane. More preferably, a transmembrane domain includes at least 20, 21, 22, 23, 24, 25, 26, 27, 28, 29, 30, 31, 32, 33, 34, 35, 36, 37, 38, 39, 40, 41, 42, 43, 44, or 45 amino acid residues and spans the plasma membrane. In some embodiments, the transmembrane domain of the present invention may be derived either from a natural or from a synthetic source. The transmembrane domain of a CAR may be derived from any naturally membrane-bound or transmembrane protein. For example, the transmembrane region may be derived from (i.e. comprise at least the transmembrane region(s) of) the alpha, beta or zeta chain of the T-cell receptor, CD3 epsilon, CD4, CD5, CD8, CD8α, CD9, CD16, CD22, CD33, CD28, CD37, CD45, CD64, CD80, CD86, CD134, CD137, CD152, or CD154.

Alternatively, the transmembrane domain of the present invention may be synthetic. In some aspects, the synthetic sequence may comprise predominantly hydrophobic residues such as leucine and valine.

In some embodiments, the transmembrane domain of the present invention may be selected from the group consisting of a CD8a transmembrane domain, a CD4 transmembrane domain, a CD 28 transmembrane domain, a CTLA-4 transmembrane domain, a PD-1 transmembrane domain, and a human IgG4 Fc region. As non-limiting examples, the transmembrane domain may be a CTLA-4 transmembrane domain comprising the amino acid sequences of SEQ ID NOs.: 1-5 of International Patent Publication NO.: WO2014/100385; and a PD-1 transmembrane domain comprising the amino acid sequences of SEQ ID NOs.: 6-8 of International Patent Publication NO.: WO2014100385; the contents of each of which are incorporated herein by reference in their entirety.

In some embodiments, the CAR of the present invention may comprise an optional hinge region (also called spacer). A hinge sequence is a short sequence of amino acids that facilitates flexibility of the extracellular targeting domain that moves the target binding domain away from the effector cell surface to enable proper cell/cell contact, target binding and effector cell activation (Patel et al., Gene Therapy, 1999; 6: 412-419). The hinge sequence may be positioned between the targeting moiety and the transmembrane domain. The hinge sequence can be any suitable sequence derived or obtained from any suitable molecule. The hinge sequence may be derived from all or part of an immunoglobulin (e.g., IgG1, IgG2, IgG3, IgG4) hinge region, i.e., the sequence that falls between the CHI and CH2 domains of an immunoglobulin, e.g., an IgG4 Fc hinge, the extracellular regions of type 1 membrane proteins such as CD8a CD4, CD28 and CD7, which may be a wild type sequence or a derivative. Some hinge regions include an immunoglobulin CH3 domain or both a CH3 domain and a CH2 domain. In certain embodiments, the hinge region may be modified from an IgG1, IgG2, IgG3, or IgG4 that includes one or more amino acid residues, for example, 1, 2, 3, 4 or 5 residues, substituted with an amino acid residue different from that present in an unmodified hinge. Table 13 provides various transmembrane regions that can be used in the CARs described herein.

TABLE 13

Transmembrane domains

| Transmembrane domain | Amino Acid Sequence | SEQ ID NO. |
|---|---|---|
| CD8 Transmembrane domain | TTTPAPRPPTPAPTIASQPLSLRPEACRPAAGGAVHTRGLDFACDI | 6679 |
| 4-1BB Transmembrane domain | IISFFLALTSTALLFLLFFLTLRFSVVKRGR | 6680 |
| 4-1BB Transmembrane domain | IISFFLALTSTALLFLLFFLTLRFSVV | 6681 |
| CD134 (OX40) Transmembrane domain | VAAILGLGLVLGLLGPLAILLALYLL | 6682 |
| CD148 Transmembrane and intracellular domain | AVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEVVTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA | 6683 |
| CD148 Transmembrane domain | AVFGCIFGALVIVTVGGFIFW | 6684 |
| CD2 Transmembrane domain | KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD | 6685 |

TABLE 13-continued

Transmembrane domains

| Transmembrane domain | Amino Acid Sequence | SEQ ID NO. |
|---|---|---|
| CD28 Transmembrane and intracellular domain | IEVMYPPPYLDNEKSNGTITHVKGKHLCPSPLFPGPSKPFW VLVVVGGVLACYSLLVTVAHIFWVRSKRSRLLHSDYMN MTPRRPGPTRKHYQPYAPPRDFAAYRS | 6686 |
| CD28 Transmembrane domain | FWVLVVVGGVLACYSLLVTVAFIIFWV | 6687 |
| CD28 Transmembrane domain | IEVMYPPPYLDNEKSNGTIIHVKGKHLCPSPLFPGPSKPFW VLVVVGGVLACYSLLVTVAFIIFWV | 6688 |
| CD28 Transmembrane domain | IFWVLVVVGGVLACYSLLVTVAFIIFWVRSKRR | 6689 |
| CD28 Transmembrane domain | FWVLVVVGGVLACYSLLVTVAFIIFWVRSKRSRLLHSDY MNMTPRRPGPTRKHYQPYAPPRDFAAYRS | 6690 |
| CD28 Transmembrane domain | MFWVLVVVGGVLACYSLLVTVAFIIFWV | 6691 |
| CD28 Transmembrane domain | FWVLVVVGGVLACYSLLVTVAFHFWV | 6692 |
| CD28 Transmembrane domain | MFWVLVVVGGVLACYSGGVTVAFIIFWV | 6693 |
| CD28 Transmembrane domain | WVLVVVGGVLACYSLLVTVAFIIFWV | 6694 |
| CD28 Transmembrane domain | PFWVLVVVGGVLACYSLLVTVAFIIFWVRSKRSRLLHSDY MNMTPRRPGPTRKHYQPYAPPRDFAAYRS | 6695 |
| CD28 Transmembrane domain and CD28 and CD3 Zeta intracellular domain | FWVLVVVGGVLACYSLLVTVAFIIFWVRSKRSRLLHSDY MNMTPRRPGPTRKHYQPYAPPRDFAAYRSRVKFSRSADA PAYQQGQNQLYNELNLGRREEYDVLDKRRGRDPEMGGK PRRKNPQEGLYNELQKDKMAEAYSEIGMKGERRRGKGH DGLYQGLSTATKDTYDALHMQALPPR | 6696 |
| CD28 Transmembrane domain and CD28, OX40, and CD3 Zeta intracellular domain | FWVLVVVGGVLACYSLLVTVAFIIFWVRSKRSRLLHSDY MNMTPRRPGPTRKHYQPYAPPRDFAAYRSRDQRLPPDAH KPPGGGSFRTPIQEEQADAHSTLAKIRVKFSRSADAPAYQ QGQNQLYNELNLGRREEYDVLDKRRGRDPEMGGKPRRK NPQEGLYNELQKDKMAEAYSEIGMKGERRRGKGHDGLY QGLSTATKDTYDALHMQALPPR | 6697 |
| CD28 Transmembrane domain and CD3 Zeta intmcellular domain | FWVLVVVGGVLACYSLLVTVAFIIFWVRRVKFSRSADAP AYQQGQNQLYNELNLGRREEYDVLDKRRGRDPEMGGKP RRKNPQEGLYNELQKDKMAEAYSEIGMKGERRRGKGHD GLYQGLSTATKDTYDALHMQALPPR | 6698 |
| CD28 transmembrane-CD3 zeta signaling domain ("28z") | AAAIEVMYPPPYLDNEKSNGTIIHVKGKHLCPSPLFPGPSK PFWVLVVVGGVLACYSLLVTVAFIIFWVRSKRSRLLHSDY MNMTPRRPGPTRKHYQPYAPPRDFAAYRSRVKFSRSADA PAYQQGQNQLYNELNLGRREEYDVLDKRRGRDPEMGGK PRRKNPQEGLYNELQKDKMAEAYSEIGMKGERRRGKGH DGLYQGLSTATKDTYDALHMQALPPR | 6699 |
| CD3 zeta Transmembrane domain | LCYLLDGILFIYGVILTALFLRV | 6700 |
| CD3 zeta Transmembrane domain | MKWKALFTAAILQAQLPITEAQSFGLLDPKLCYLLDGILFI YGVILTALFL | 6701 |
| CD3 zeta Transmembrane domain | LCYLLDGILFIYGVILTALFL | 6702 |
| CD4 Transmembrane domain | ALIVLGGVAGLLLFIGLGIFFCVRC | 6703 |
| CD4 Transmembrane domain | MALIVLGGVAGLLLFIGLGIFF | 6704 |

TABLE 13-continued

| Transmembrane domains | | |
|---|---|---|
| Transmembrane domain | Amino Acid Sequence | SEQ ID NO. |
| CD45 Transmembrane and intracellular domain | ALIAFLAFLIIVTSIALLVVLYKIYDLHKKRSCNLDEQQELV ERDDEKQLMNVEPIHADILLETYKRKIADEGRLFLAEFQSI PRVFSKFPIKEARKPFNQNKNRYVDILPYDYNRVELSEING DAGSNYINASYIDGFKEPRKYIAAQGPRDETVDDFWRMI WEQKATVIVMVTRCEEGNRNKCAEYWPSMEEGTRAFGD VVVKINQHKRCPDYIIQKLNIVNKKEKATGREVTHIQFTS WPDHGVPEDPHLLLKLRRRVNAFSNFFSGPIWHCSAVG RTGTYIGIDAMLEGLEAENKVDVYGYVVKLRRQRCLMV QVEAQYILIHQALVEYNQFGETEVNLSELHPYLHNMKKR DPPSEPSPLEAEFQRLPSYRSWRTQHIGNQEENKSKNRSN VIPYDYNRVPLKHELEMSKESEHDSESSDDDSDSEEPSK YINASFIMSYWKPEVMIAAQGPLKETIGDFWQMIFQRKVK VIVMLTELKHGDQEICAQYWGEGKQTYGDIEVDLKDTDK SSTYTLRVFELRHSKRKDSRTVYQYQYTNWSVEQLPAEP KELISMIQWKQKLPQKNSSEGNKHHKSTPLLIHCRDGSQQ TGIFCALLNLLESAETEEWDIFQWKALRKARPGMVSTFEQ YQFLYDVIASTYPAQNGQVKKNNHQEDKIEFDNEVDKVK QDANCVNPLGAPEKLPEAKEQAEGSEPTSGIEGPEHSVNG PASPALNQGS | 6705 |
| CD62L Transmembrane domain | PLFIPVAVMVTAFSGLAFIIWLA | 6706 |
| CD7 Transmembrane domain | ALPAALAVISFLLGLGLGVACVLA | 6707 |
| CD8 Transmembrane domain | MALPVTALLLPLALLLHAARP | 6708 |
| CD8 Transmembrane domain and CD28 signaling domain | AAAFVPVFLPAKPTTTPAPRPPTPAPTIASQPLSLRPEACRP AAGGAVHTRGLDFACDIYIWAPLAGTCGVLLLSLVITLYC NHRNRSKRSRLLHSDYMNMTPRRPGPTRKHYQPYAPPRD FAAYRSRFSVVKRGRKKLLYIFKQPFMRPVQTTQEEDGCS CRFPEEEEGGCELRVKFSRSADAPAYQQGQNQLYNELNL GRREEYDVLDKRRGRDPEMGGKPRRKNPQEGLYNELQK DKMAEAYSEIGMKGERRRGKGHDGLYQGLSTATKDTYD ALHMQALPPR | 6709 |
| CD8 transmembrane domain-CD137 (4-1BB) signaling domain and CD3 zeta signaling domain ("BBz") | AAATTTPAPRPPTPAPTIASQPLSLRPEACRPAAGGAVHTR GLDFACDIYIWAPLAGTCGVLLLSLVITLYCKRGRKKLLYI FKQPFMRPVQTTQEEDGCSCRFPEEEEGGCELRVKFSRSA DAPAYKQGQNQLYNELNLGRREEYDVLDKRRGRDPEMG GKPRRKNPQEGLYNELQKDKMAEAYSEIGMKGERRRGK GHDGLYQGLSTATKDTYDALHMQALPPR | 6710 |
| CD8a Transmembrane domain | FVPVFLPAKPTTTPAPRPPTPAPTIASQPLSLRPEACRPAAG GAVHTRGLDFACDIYIWAPLAGTCGVLLLSLVITLYCNHR N | 6711 |
| CD8a Transmembrane domain | IWAPLAGTCGVLLLSLVITLYC | 6712 |
| CD8a Transmembrane domain | IYIWAPLAGTCGVLLLSLVITLYC | 6713 |
| CD8a Transmembrane domain | IYIWAPLAGTCGVLLLSLVITLYCR | 6714 |
| CD8a Transmembrane domain | IYIWAPLAGTCGVLLLSLVITLVCR | 6715 |
| CD8a Transmembrane domain | IYIWAPLAGTCGVLLLSLVIT | 6716 |
| CD8a Transmembrane domain | IYIWAPLAGTCGVLLLSLVITLY | 6717 |
| CD8b Transmembrane domain | LGLLVAGVLVLLVSLGVAIHLCC | 6718 |
| EpoR Transmembmne domain | APVGLVARLADESGHVVLRWLPPPETPMTSHIRYEVDVS AGNGAGSVQRVEILEGRTECVLSNLRGRTRYTFAVRARM AEPSFGGFWSAWSEPVSLLTPSD | 6719 |

TABLE 13-continued

Transmembrane domains

| Transmembrane domain | Amino Acid Sequence | SEQ ID NO. |
|---|---|---|
| FcERIa-Transmembrane domain | MAPAMESPTLLCVALLFFAPDGVLAVPQKPKVSLNPPWN RIFKGENVTLTCNGNNFFEVSSTKWFHNGSLSEETNSSLNI VNAKFEDSGEYKCQHQQVNESEPVYLEVFSDWLLLQASA EVVMEGQPLFLRCHGWRNWDVYKVIYYKDGEALKYWY ENHNISITNATVEDSGTYYCTGKVWQLDYESEPLNITVIKA PREKYWLQFFIPLLVVILFAVDTGLFISTQQQVTFLLKIKRT RKGFRLLNPHPKPNPKNN | 6720 |
| FceRIa Transmembrane domain | DIFIPLLVVILFAVDTGLFISTQQQVTFLLKIKRTRKGFRLL NPHPKPNPKNNR | 6721 |
| GITR Transmembrane domain | PLGWLTVVLLAVAACVLLLTSAQLGLHIWQL | 6722 |
| Her2 Transmembrane domain | SIISAVVGILLVVVLGVVFGILII | 6723 |
| Her2 Transmembrane domain | CHPECQPQNGSVTCFGPEADQCVACAHYKDPPFCVARCP SGVKPDLSYMPIWKFPDEEGACQPCPINCTHSCVDLDDKG CPAEQRASPLTSIISAVVGILLVVVLGVVFGILI | 6724 |
| ICOS Transmembrane domain | FWLPIGCAAFVVVCILGCILI | 6725 |
| IgG1 Transmembrane domain | EPKSPDKTHTCPPCPAPPVAGPSVFLFPPKPKDTLMIARTP EVTCVVVDVSHEDPEVKFNWYVDGVEVHNAKTKPREEQ YNSTYRVVSVLTVLHQDWLNGKEYKCKVSNKALPAPIEK TISKAKGQPREPQVYTLPPSRDELTKNQVSLTCLVKGFYPS DIAVEWESNGQPENNYKTTPPVLDSDGSFFLYSKLTVDKS RWQQGNVFSCSVMHEALHNHYTQKSLSLSPGKKD | 6726 |
| OX40 Transmembrane domain | VAAILGLGLVLGLLGPLAILL | 6727 |
| Transmembrane domain | IYIWAPLAGTCGVLLLSLVITLYC | 6728 |
| Transmembrane domain | IYIWAPLAGTCGVLLLSLVITLYC | 6729 |

Hinge region sequences useful in the present invention are provided in Table 14.

TABLE 14

Hinge regions

| Hinge Domain | Amino Acid Sequence | SEQ ID NO. |
|---|---|---|
| Hinge | DKTHT | 6730 |
| Hinge | CPPC | 6731 |
| Hinge | CPEPKSCDTPPPCPR | 6732 |
| Hinge | ELKTPLGDTTHT | 6733 |
| Hinge | KSCDKTHTCP | 6734 |
| Hinge | KCCVDCP | 6735 |
| C233P Hinge | KYGPPCP | 6736 |
| C233S Hinge | VEPKSPDKTHTCPPCP | 6737 |
| CD28 Hinge | LDPKSSDKTHTCPPCP | 6738 |
| CD8a Hinge | IEVMYPPPYLDNEKSNGTIIHVKGKHLCPSPLFPGPSKP | 6739 |
| CD8a Hinge | GGAVHTRGLDFA | 6740 |
| CD8a Hinge | TTTPAPRPPTPAPTIASQPLSLRPEACRPAAGGAVHTRGLD FACD | 6741 |

TABLE 14-continued

Hinge regions

| Hinge Domain | Amino Acid Sequence | SEQ ID NO. |
|---|---|---|
| CD8a Hinge | AKPTTTPAPRPPTPAPTIASQPLSLRPEACRPAAGGAVHTRGLDFACD | 6742 |
| CD8a Hinge | TTTPAPRPPTPAPTIASQPLSLRPEACRPAAGGAVHTRGLDFACD | 6743 |
| CD8a Hinge | TTTPAPRPPTPAPTIASQPLSLRPEACRPAAGGAVHTRGLDFACD | 6744 |
| CD8a Hinge | TTTPAPRPPTPAPTIASQPLSLRPEACRPAAGGAVHTRGLDFACDEPKSPDKTHTCPPCPAPPVAGPSVFLFPPKPKDT | 6745 |
| CD8a Hinge | PAKPTTTPAPRPPTPAPTIASQPLSLRPEACRPAAGGAVHTRGLDFACDIY | 6746 |
| CD8a Hinge | TTTPAPRPPTPAPTIASQPLSLRPEACRPAAGGAVHTRGLDFACDIYIWAPLAGTCGVLLLSLVITLYC | 6747 |
| CD8a Hinge | TTPAPRPPTPAPTIASQPLSLRPEACRPAAGGAVHTRGLDFACD | 6748 |
| Delta5 Hinge | TTTPAPRPPTPAPTIASQPLSLRPEACRPAAGGAVHTRGLDFACDIY | 6749 |
| EpoR Hinge | LDKTHTCPPCP | 6750 |
| FCRIIα Hinge | APVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSD | 6751 |
| FcγRIIIα Hinge | GLAVSTISSFFPPGYQ | 6752 |
| Hinge | GLAVSTISSFFPPGYQ | 6753 |
| Hinge | RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH | 6754 |
| Hinge | YVTVSSQDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPK | 6755 |
| Hinge | KPTTTPAPRPPTPAPTIASQPLSLRPEACRPAAGGAVHTRGLDFA | 6756 |
| Hinge | LEPKSCDKTHTCPPCP | 6757 |
| Hinge | KPTTTPAPRPPTPAPTIASQPLSLRPEACRPAAGGAVHTRGLD | 6758 |
| Hinge | EPKSCDKTHTCPPCP | 6759 |
| Hinge | ELKTPLGDTHTCPRCP | 6760 |
| Hinge | EPKSCDTPPPCPRCP | 6761 |
| Hinge | ESKYGPPCPSCP | 6762 |
| Hinge (CH2-CH3) | ERKCCVECPPCP | 6763 |

TABLE 14-continued

Hinge regions

| Hinge Domain | Amino Acid Sequence | SEQ ID NO. |
|---|---|---|
| Hinge (CH3) | ESKYGPPCPPCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGK | 6764 |
| IgD Hinge | ESKYGPPCPPCPGQPREPQVYTLPPSQEEMTKNQVSLTCL VKGFYPSDIAVEWESNGQPENNYKTTPPVLDSDGSFFLYS RLTVDKSRWQEGNVFSCSVMHEALHNHYTQKSLSLSLGK | 6765 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPPQPGSTTFW AWSVLRVPAPPSPQPATYTCVVSHEDSRTLLNASRSLEVS YVTDH | 6766 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLHPSL PPQRLMALREPAAQAPVKLSLNLLASSDPPEAASWLLCEV SGFSPPNILLMWLEDQREVNTSGFAPARPPPQPGSTTFWA WSVLRVPAPPSPQPATYTCVVSHEDSRTLLNASRSLEVSY VTDH | 6767 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMVVLEDQREVNTSGFAPARPPPQPGSTTFW AWSVLRVPAPPSPQPATYTCVVSHEDSRTLLNASRSLEVS YVTDH | 6768 |
| IgD Hinge | ESPKAQASSVPTAQPQAEGSLAKATTAPATTRNTGRGGEE KKKEKEKEEQEERETKTP | 6769 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPPQPGSTTFW AWSVLRVPAPPSPQPATYTCVVSHEDSRTLLNASRSLEVS YVTDH | 6770 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPPQPGSTTFW AWSVLRVPAPPSPQPATYTCVVSHEDSRTLLNASRSLEVS YVTDH | 6771 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPQPGSTTFWA WSVLRVPAPPSPQPATYTCVVSHEDSRTLLNASRSLEVSY VTDH | 6772 |

TABLE 14-continued

Hinge regions

| Hinge Domain | Amino Acid Sequence | SEQ ID NO. |
|---|---|---|
| IgG1 (CH2CH3) Hinge domain | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPPQPGSTTFW AWSVLRVPAPPSPQPATYTCVVSHEDSRTLLNASRSLEVS YVTDH | 6773 |
| IgG1 (CH2CH3) Hinge domain | AEPKSPDKTHTCPPCPAPPVAGPSVFLFPPKPKDTLMIART PEVTCVVVDVSHEDPEVKFNWYVDGVEVHNAKTKPREE QYNSTYRVVSVLTVLHQDWLNGKEYKCKVSNKALPAPIE KTISKAKGQPREPQVYTLPPSRDELTKNQVSLTCLVKGFY PSDIAVEWESNGQPENNYKTTPPVLDSDGSFFLYSKLTVD KSRWQQGNVFSCSVMHEALHNHYTQKSLSLSPGKKD | 6774 |
| IgG1 Hinge | AEPKSPDKTHTCPPCPAPPVAGPSVFLFPPKPKDTLMIART PEVTCVVVDVSHEDPEVKFNWYVDGVEVHNAKTKPREE QYNSTYRVVSVLTVLHQDWLNGKEYKCKVSNKALPAPIE KTISKAKGQPREPQVYTLPPSRDELTKNQVSLTCLVKGFY PSDIAVEWESNGQPENNYKTTPPVLDSDGSFFLYSKLTVD KSRWQQGNVFSCSVMHEALHNHYTQKSLSLSPGKKD | 6775 |
| IgG1 Hinge | AEPKSPDKTHTCPPCPKDPK | 6776 |
| IgG1 Hinge | EPKSCDKTHTCPPCP | 6777 |
| IgG1 Hinge | EPKSPDKTHTCPPCPAPPVAGPSVFLFPPKPKDTLMIARTP EVTCVVVDVSHEDPEVKFNWYVDGVEVHNAKTKPREEQ YNSTYRVVSVLTVLHQDWLNGKEVKCKVSNKALPAPIEK TISKAKGQPREPQVYTLPPSRDELTKNQVSLTCLVKGFYPS DIAVEWESNGQPENNYKTTPPVLDSDGSFFLVSKLTVDKS RWQQGNVFSCSVMHEALHNHYTQKSLSLSPGKKD | 6778 |
| IgG1 Hinge | SVFLFPPKPKDTL | 6779 |
| IgG1 Hinge | EPKSPDKTHTCPPCPAPPVAGPSVFLFPPKPKDTLMIARTP EVTCVVVDVSHEDPEVKFNWYVDGVEVHNAKTKPREEQ YNSTYRVVSVLTVLHQDWLNGKEYKCKVSNKALPAPIEK TISKAKGQPREPQVYTLPPSRDELTKNQVSLTCLVKGFYPS DIAVEWESNGQPENNYKTTPPVLDSDGSFFLYSKLTVDKS RWQQGNVFSCSVMHEALHNHYTQKSLSLSPGK | 6780 |
| IgG1 Hinge | EPKSPDKTHTCPPCPAPPVAGPSVFLFPPKPKDTLMIARTP EVTCVVVDVSHEDPEVKFNWYVDGVEVHNAKTKPREEQ YNSTYRVVSVLTVLHQDWLNGKEYKCKVSNKALPAPIEK TISKAKGQPREPQVYTLPPSRDELTKNQVSLTCLVKGFYPS DIAVEWESNGQPENNYKTTPPVLDSDGSFFLYSKLTVDKS RWQQGNVFSCSVMHEALHNHYTQKSLSLSPGKKDPK | 6781 |
| IgG1 Hinge (CH2CH3 domain) | VECPPCPAPPVAGPSVFLFPPKPKDTLMISRTPEVTCVVVD VSHEDPEVKFNWYVDGVEVHNAKTKPREEQYNSTYRVV SVLTVLHQDWLNGKEYKCKVSNKGLPSSIEKTISKAKGQP REPQVYTLPPSREEMTKNQVSLTCLVKGFYPSDIAVEWES NGQPENNYKTTPPVLDSDGSFFLYSKLTVDKSRWQQGNV FSCSVMHEALHNHYTQKSLSLSPGK | 6782 |
| IgG2 Hinge | DPAEPKSPDKTHTCPPCPAPPVAGPSVFLFPPKPKDTLMIA RTPEVTCVVVDVSHEDPEVKFNWYVDGVEVHNAKTKPR EEQYNSTYRVVSVLTVLHQDWLNGKEYKCKVSNKALPA PIEKTISKAKGQPREPQVYTLPPSRDELTKNQVSLTCLVKG FYPSDIAVEWESNGQPENNYKTTPPVLDSDGSFFLYSKLT VDKSRWQQGNVFSCSVMHEALHNHYTQKSLSLSPGKK | 6783 |
| IgG3 Hinge | ERKCCVECPPCP | 6784 |
| IgG3 Hinge | ELKTPLGDTTHTCPRCP | 6785 |
| IgG4 (CH2 and CH3) | ELKTPLGDTTHTCPRCPEPKSCDTPPPCPRCPEPKSCDTPPPC PRCPEPKSCDTPPPCPRCP | 6786 |

TABLE 14-continued

Hinge regions

| Hinge Domain | Amino Acid Sequence | SEQ ID NO. |
|---|---|---|
| IgG4 (CH2 and CH3) | ESKYGPPCPPCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGKM | 6787 |
| IgG4 Hinge | ESKYGPPCPPCPAPEFEGGPSVFLFPPKPKDTLMISRTPEVT CVVVDVSQEDPEVQFNWYVDGVEVHNAKTKPREEQFQS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGKM | 6788 |
| IgG4 Hinge | SPNMVPHAHHAQ | 6789 |
| IgG4 Hinge | GQPREPQVYTLPPSQEEMTKNQVSLTCLVKGFYPSDIAVE WESNGQPENNYKTTPPVLDSDGSFFLYSRLTVDKSRWQE GNVFSCSVMHEALHNHYTQKSLSLSLGK | 6790 |
| IgG4 Hinge | ESKYGPPCPPCPGGGSSGGGSGGQPREPQVYTLPPSQEEM TKNQVSLTCLVKGFYPSDIAVEWESNGQPENNYKTTPPVL DSDGSFFLYSRLTVDKSRWQEGNVFSCSVMHEALHNHYT QKSLSLSLGK | 6791 |
| IgG4 Hinge | ESKYGPPCPSCPAPEFEGGPSVFLFPPKPKDTLMISRTPEVT CVVVDVSQEDPEVQFNWYVDGVEVHQAKTKPREEQFNS TYRVVSVLTVLHQDWLNGKEYKCKVSNKGLPSSIEKTISK AKGQPREPQVYTLPPSQEEMTKNQVSLTCLVKGFVPSDIA VEWESNGQPENNYKTTPPVLDSDGSFFLYSRLTVDKSRW QEGNVFSCSVMHEALHNHYTQKSLSLSLGK | 6792 |
| IgG4 Hinge | ESKYGPPCPPCPAPEFEGGPSVFLFPPKPKDTLMISRTPEVT CVVVDVSQEDPEVQFNWYVDGVEVHQAKTKPREEQFNS TYRVVSVLTVLHQDWLNGKEYKCKVSNKGLPSSIEKTISK AKGQPREPQVYTLPPSQEEMTKNQVSLTCLVKGFVPSDIA VEWESNGQPENNYKTTPPVLDSDGSFFLYSRLTVDKSRW QEGNVFSCSVMHEALHNHYTQKSLSLSLGK | 6793 |
| IgG4 Hinge | ESKYGPPCPPCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGKM | 6794 |
| IgG4 Hinge | ESKYGPPCPPCP | 6795 |
| IgG4 Hinge | ESKYGPPCPPCPGQPREPQVYTLPPSQEEMTKNQVSLTCL VKGFYPSDIAVEWESNGQPENNYKTTPPVLDSDGSFFLYS RLTVDKSRWQEGNVFSCSVMHEALHNHYTQKSLSLSLGK | 6796 |
| IgG4 Hinge | ESKYGPPCPPCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGK | 6797 |
| IgG4 Hinge | ESKYGPPCPPCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGK | 6798 |
| IgG4 Hinge | YGPPCPPCP | 6799 |
| IgG4 Hinge | KYGPPCPPCP | 6800 |
| IgG4 Hinge | EVVKYGPPCPPCP | 6801 |

TABLE 14-continued

Hinge regions

| Hinge Domain | Amino Acid Sequence | SEQ ID NO. |
|---|---|---|
| IgG4 Hinge and Linker | ESKYGPPCPSCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDLSRW QEGNVFSCSVMHEALHNHYTQKSLSLSLGK | 6802 |
| IgG1 Hinge | ESKYGPPCPPCPGGGSSGGGSG | 6803 |
| IgG1 Hinge | EPKSPDKTHTCPPCPAPPVAGPSVFLFPPKPKDTLMIARTP EVTCVVVDVSHEDPEVKFNWYVDGVEVHNAKTKPREEQ YNSTYRVVSVLTVLHQDWLNGKEYKCKVSNKALPAPIEK TISKAKGQPREPQVYTLPPSRDELTKNQVSLTCLVKGFYPS DIAVEWESNGQPENNYKTIPPVLDSDGSFFLYSKLTVDKS RWQQGNVFSCSVMHEALHNHYTQKSLSLSPGK | 6804 |
| IgG1 Hinge | EPKSPDKTHTCPPCPAPPVAGPSVFLFPPKPKDTLMIARTP EVTCVVVDVSHEDPEVKFNWYVDGVEVHNAKTKPREEQ YNSTYRVVSVLTVLHQDWLNGKEYKCKVSNKALPAPIEK TISKAKGQPREPQVYTLPPSRDELTKNQVSLTCLVKGFYPS DIAVEWESNGQPENNYKTIPPVLDSDGSFFLYSKLTVDKS RWQQGNVFSCSVMHEALHNHYTQKSLSLSPGK | 6805 |
| IgG1 Hinge | EPKSPDKTHTCPPCPAPPVAGPSVFLFPPKPKDTLMIARTP EVTCVVVDVSHEDPEVKFNWYVDGVEVHNAKTKPREEQ YNSTYRVVSVLTVLHQDWLNGKEYKCKVSNKALPAPIEK TISKAKGQPREPQVYTLPPSRDELTKNQVSLTCLVKGFYPS DIAVEWESNGQPENNYKTTPPVLDSDGSFFLYSKLTVDKS RWQQGNVFSCSVMHEALHNHYTQKSLSLSPGK | 6806 |

In some embodiments, hinge domains and the transmembrane domains may be paired. The hinge domain may be present at the N terminus of the transmembrane domain, at C terminus of the transmembrane domain or within the transmembrane domain. Hinge and transmembrane region sequences which may be useful in the present invention are provided in Table 15.

In some embodiments, the CAR of the present invention may comprise one or more linkers between any of the domains of the CAR. The linker may be between 1-30 amino acids long. In this regard, the linker may be 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 amino acids in length. In other embodiments, the linker may be flexible.

TABLE 15

Paired Hinge and Transmembrane regions

| Hinge Domain | Amino Acid Sequence | SEQ ID NO. |
|---|---|---|
| CD8a Transmembmne and Hinge | TTPAPRPPTPAPTIASQPLSLRPEACRPAAGGAVHTRGLDF ACDIYIWAPLAGTCGVLLLSLVITLYC | 6807 |
| CD8a Transmembmne and Hinge | DIQMTQSSSYLSVSLGGRVTITCKASDHINNWLAWYQQK PGNAPRLLISGATSLETGVPSRFSGSGSGKDYTLSITSLQTE DVATYYCQQYWSTPFTFGSGTKLEIKGGGGSGGGGSGGG GSQVQLKESGPGLVAPSQSLSITSTVSGFSLSRYSVHWVR QPPGKGLEWLGMIWGGGSTDYNSALKSRLSISKDNSKSQ VFLKMNSLQTDDTAMYYCARNEGDTTAGTWFAYWGQG TLVTVSS | 6808 |
| CD8a Transmembmne and Hinge | ALSNSIMYFSHFVPVFLPAKPTTTPAPRPPTPAPTIASQPLS LRPEACRPAAGGAVHTRGLD | 6809 |
| CD8a Transmembmne and Hinge | TTTPAPRPPTPAPTIASQPLSLRPEACRPAAGGAVHTRGLD FACDIYIWAPLAGTCGVLLLSLVITLY | 6810 |
| CD8a Transmembmne and Hinge | KPTTTPAPRPPTPAPTIASQPLSLRPEACRPAAGGAVHTRG LDFACDIYIWAPLAGTCGVLLLSLVITLY | 6811 |

In some embodiments, the components including the targeting moiety, transmembrane domain and intracellular signaling domains of the present invention may be constructed in a single fusion polypeptide. The fusion polypeptide may be the payload of an effector module of the invention. In some embodiments, more than one CAR fusion polypeptides may be included in an effector module, for example, two, three or more CARs may be included in the effector module under the control of a single SRE (e.g., a DD). Representative effector modules comprising the CAR payload are illustrated in FIGS. 2-6.

In some embodiments, payloads of the present invention may comprise the CAR constructs including the extracellular targeting domain, transmembrane domain and intracellular signaling domains that are taught in the art, for example, a CAR targeting mesothelin (U.S. Pat. Nos. 9,272,002 and 9,359,447); EGFRvIII specific CARs in U.S. Pat. No. 9,266,960; anti-TAG CARs in U.S. Pat. No. 9,233,125; CD19 CARs in US Patent publication NO.: 2016014533; CD19 CAR having the amino acid sequence of SEQ ID NO.: 24 of U.S. Pat. No. 9,328,156; CD19 CARs in U.S. Pat. Nos. 8,911,993; 8,975,071; 9,101,584; 9,102,760; and 9,102,761; BCMA (CD269) specific CARs disclosed in International patent publication NOs: WO2016/014565 (SEQ ID Nos.: 109-113 and 213 to 233) and WO2016/014789; CLL-1 (C-type lectin-like molecule 1) CARs comprising the amino acid sequences of SEQ ID NOs: 99, 96, 100, 101, 102, 91, 92, 93, 94, 95, 97, 98, 103, and 197 disclosed in International patent publication NO.: WO2016014535; CD33 specific CARs comprising the amino acid sequences of SEQ ID NOs: 48-56 in International patent publication NO.: WO2016014576; CD33 specific CARs comprising the amino acid sequences of SEQ ID NOs: 19-22, 27-30 and 35-38 in International patent publication NO.: WO2015150526; CD37 specific CARs encoded by the nucleic acids of SEQ ID NOs: 1-5 in US patent publication NO.: US20150329640; GPC3 CAR (International patent publication NO.: WO2016036973), GFR alpha 4 CARs having the amino acid sequences of SEQ ID NOs: 85, 86, 90, 92, 94, 96, 98, 100, 102, and 104 in International patent publication NO.: WO2016025880; CD123 CARs comprising the amino acid sequences of SEQ ID NO: 98, 99, 100 and 101 in International patent publication NOs: WO2016028896; CD123 specific multi-chain CARs in International patent publication NO: WO2015193406; CD123 CARS comprising the amino acid sequences of SEQ ID NO.: 160, 171, 188-197 in International patent publication NO: WO2016/120220; ROR-1 specific CARs comprising the amino acid sequences of SEQ ID NOs: 93, 95 and 117 in International patent publication NO.: WO2016/016344; ROR-1 specific multi-chain CARs in International patent publication NO.: WO2016/016343; trophoblast glycoprotein (5T4, TPBG) specific CARs comprising the amino acid sequences of SEQ ID NOs: 21, 27, 33, 39, 23, 29, 34, 41, 19, 25, 31, 37, 20, 26, 32, 38, 22, 28, 34, 40, 24, 30, 36 and 42 in International patent publication NO.: WO2016034666; EGFRvIII specific CARs comprising the amino acid sequences of SEQ ID NOs: 15, 17, 24, 25, 26 and 27 in International patent publication NO.: WO2016016341; a TEM 8 CAR comprising the amino acid sequence of SEQ ID NO: 1 in International patent publication NO.: WO2014164544, a TEM1 CAR comprising the amino acid sequence of SEQ ID NO:2 in International patent publication NO.: WO2014164544; GPC-3 CAR having the amino acid sequences of SEQ ID NOs: 3 and 26 in International patent publication NO.: WO2016/049459; a chondroitin sulfate proteoglycan-4 (CSPG4) CAR in International patent publication NO.: WO2015/080981; Kappa/lambda CARs in International patent publication NO.: WO2015/164739; GD2 CAR in International patent publication NO.: WO2016/134284; CLL1 CARs in International patent publication NO.: WO2016120218; CLL1 multi-subunit CARs in International patent publication NO.: WO2016120219; Hsp70 CARs in International patent publication NO.: WO2016120217; mAb-driven CARs in International patent publication NO.: WO2016120216; the contents of each of which are incorporated herein by reference in their entirety.

In some embodiments, the CAR constructs of the present invention may include CAIX (carboxy-anhydrase-IX (CAIX) specific CAR (Lamers et al., *Biochem Soc Trans*, 2016, 44(3): 951-959), HIV-1 specific CAR (Ali et al., *J Virol.*, 2016, May 25, pii: JVI.00805-16), CD20 specific CAR (Rufener et al., *Cancer Immunol. Res.*, 2016, 4(6): 509-519), a CD20/CD19 bispecific CAR (Zah et al., *Cancer Immunol Res.*, 2016, 4(6): 498-508), a CD22/CD19 CAR (International Publication No: WO2016/149578), a CD138/BCMA bi-specific CAR (International Publication No: WO2016/130598) an EGFR specific CARs and anti EGFR viii specific CAR; the contents of each of which are incorporated herein by reference in their entirety.

In some embodiments, the CAR sequences may be selected from Table 16.

TABLE 16

CAR sequences

| Description | SEQ ID NO | Source |
|---|---|---|
| CD70 CAR | 6812 | SEQ ID NO. 99 in WO2015121454 |
| Acid/Base Leucine zipper zip CAR | 6813 | SEQ ID NO. 34 in WO2016124930 |
| Acid/Base Leucine zipper zip CAR | 6814 | SEQ ID NO. 35 in WO2016124930 |
| ALK CAR | 6815 | SEQ ID NO. 43 in WO2015069922 |
| ALK CAR | 6816 | SEQ ID NO. 44 in WO2015069922 |
| ALK CAR | 6817 | SEQ ID NO. 45 in WO2015069922 |
| ALK CAR | 6818 | SEQ ID NO. 46 in WO2015069922 |
| ALK CAR | 6819 | SEQ ID NO. 47 in WO2015069922 |
| ALK CAR | 6820 | SEQ ID NO. 48 in WO2015069922 |
| ALK CAR | 6821 | SEQ ID NO. 49 in WO2015069922 |
| ALK CAR | 6822 | SEQ ID NO. 50 in WO2015069922 |
| ALK CAR | 6823 | SEQ ID NO. 51 in WO2015069922 |
| ALK CAR | 6824 | SEQ ID NO. 52 in WO2015069922 |
| ALK CAR | 6825 | SEQ ID NO. 53 in WO2015069922 |
| ALK CAR | 6826 | SEQ ID NO. 54 in WO2015069922 |
| ALK CAR | 6827 | SEQ ID NO. 55 in WO2015069922 |
| ALK CAR | 6828 | SEQ ID NO. 56 in WO2015069922 |
| ALK CAR | 6829 | SEQ ID NO. 57 in WO2015069922 |

TABLE 16-continued

| CAR sequences | | |
|---|---|---|
| Description | SEQ ID NO | Source |
| ALK CAR | 6830 | SEQ ID NO. 58 in WO2015069922 |
| ALK CAR | 6831 | SEQ ID NO. 59 in WO2015069922 |
| ALK CAR | 6832 | SEQ ID NO. 60 in WO2015069922 |
| ALK CAR | 6833 | SEQ ID NO. 61 in WO2015069922 |
| ALK CAR | 6834 | SEQ ID NO. 62 in WO2015069922 |
| ALK CAR | 6835 | SEQ ID NO. 63 in WO2015069922 |
| ALK CAR | 6836 | SEQ ID NO. 64 in WO2015069922 |
| ALK CAR | 6837 | SEQ ID NO. 65 in WO2015069922 |
| ALK CAR | 6838 | SEQ ID NO. 66 in WO2015069922 |
| ALK CAR | 6839 | SEQ ID NO. 67 in WO2015069922 |
| ALK CAR | 6840 | SEQ ID NO. 68 in WO2015069922 |
| ALK CAR | 6841 | SEQ ID NO. 69 in WO2015069922 |
| ALK CAR | 6842 | SEQ ID NO. 70 in WO2015069922 |
| ALK CAR | 6843 | SEQ ID NO. 71 in WO2015069922 |
| ALK CAR | 6844 | SEQ ID NO. 72 in WO2015069922 |
| ALK CAR | 6845 | SEQ ID NO. 73 in WO2015069922 |
| ALK CAR | 6846 | SEQ ID NO. 74 in WO2015069922 |
| ALK CAR | 6847 | SEQ ID NO. 75 in WO2015069922 |
| ALK CAR | 6848 | SEQ ID NO. 76 in WO2015069922 |
| ALK CAR | 6849 | SEQ ID NO. 77 in WO2015069922 |
| ALK CAR | 6850 | SEQ ID NO. 78 in WO2015069922 |
| ALK CAR | 6851 | SEQ ID NO. 79 in WO2015069922 |
| ALK CAR | 6852 | SEQ ID NO. 80 in WO2015069922 |
| ALK CAR | 6853 | SEQ ID NO. 81 in WO2015069922 |
| ALK CAR | 6854 | SEQ ID NO. 82 in WO2015069922 |
| ALK CAR | 6855 | SEQ ID NO. 83 in WO2015069922 |
| ALK CAR | 6856 | SEQ ID NO. 84 in WO2015069922 |
| ALK CAR | 6857 | SEQ ID NO. 85 in WO2015069922 |
| ALK CAR | 6858 | SEQ ID NO. 86 in WO2015069922 |
| ALK CAR | 6859 | SEQ ID NO. 87 in WO2015069922 |
| ALK CAR | 6860 | SEQ ID NO. 88 in WO2015069922 |
| ALK CAR | 6861 | SEQ ID NO. 89 in WO2015069922 |
| ALK CAR | 6862 | SEQ ID NO. 90 in WO2015069922 |
| APRIL IgG1 hinge based CAR | 6863 | SEQ ID NO: 53 in US20160296562A1 |
| APRIL Fcpvaa based CAR | 6864 | SEQ ID NO: 52 in US20160296562A1 |
| BCMA CAR | 6865 | SEQ ID NO: 180 in WO2016168595A1 |
| BCMA CAR | 6866 | SEQ ID NO: 180 in WO2016168595A1 |
| BCMA CAR | 6867 | SEQ ID NO: 162 in WO2016168595A1 |
| BCMA CAR | 6868 | SEQ ID NO: 168 in WO2016168595A1 |
| BCMA CAR | 6869 | SEQ ID NO: 174 in WO2016168595A1 |
| BCMA CAR | 6870 | SEQ ID NO: 144 in WO2016168595A1 |
| BCMA CAR | 6871 | SEQ ID NO: 150 in WO2016168595A1 |
| BCMA CAR | 6872 | SEQ ID NO: 186 in WO2016168595A1 |
| BCMA CAR | 6873 | SEQ ID NO: 192 in WO2016168595A1 |
| BCMA CAR | 6874 | SEQ ID NO: 198 in WO2016168595A1 |
| BCMA CAR | 6875 | SEQ ID NO: 204 in WO2016168595A1 |
| BCMA CAR | 6876 | SEQ ID NO: 210 in WO2016168595A1 |
| BCMA CAR | 6877 | SEQ ID NO: 156 in WO2016168595A1 |
| BCMA CAR | 6878 | SEQ ID NO: 216 in WO2016168595A1 |
| BCMA CAR | 6879 | SEQ ID NO: 222 in WO2016168595A1 |
| BCMA CAR | 6880 | SEQ ID NO: 228 in WO2016168595A1 |
| BCMA CAR | 6881 | SEQ ID NO: 234 in WO2016168595A1 |
| BCMA CAR | 6882 | SEQ ID NO: 240 in WO2016168595A1 |
| BCMA CAR | 6883 | SEQ ID NO: 246 in WO2016168595A1 |
| BCMA CAR | 6884 | SEQ ID NO: 252 in WO2016168595A1 |
| BCMA CAR | 6885 | SEQ ID NO: 258 in WO2016168595A1 |
| BCMA CAR | 6886 | SEQ ID NO: 264 in WO2016168595A1 |
| BCMA CAR | 6887 | SEQ ID NO: 270 in WO2016168595A1 |
| BCMA CAR | 6888 | SEQ ID NO: 276 in WO2016168595A1 |
| BCMA CAR | 6889 | SEQ ID NO. 48 in WO2015158671A1 |
| BCMA CAR | 6890 | SEQ ID NO. 49 in WO2015158671A1 |
| BCMA CAR | 6891 | SEQ ID NO. 50 in WO2015158671A1 |
| BCMA CAR | 6892 | SEQ ID NO. 51 in WO2015158671A1 |
| BCMA CAR | 6893 | SEQ ID NO. 52 in WO2015158671A1 |
| BCMA CAR | 6894 | SEQ ID NO. 53 in WO2015158671A1 |
| BCMA CAR | 6895 | SEQ ID NO. 54 in WO2015158671A1 |
| BCMA CAR | 6896 | SEQ ID NO. 55 in WO2015158671A1 |
| BCMA CAR | 6897 | SEQ ID NO. 56 in WO2015158671A1 |
| BCMA CAR | 6898 | SEQ ID NO. 57 in WO2015158671A1 |
| BCMA CAR | 6899 | SEQ ID NO. 58 in WO2015158671A1 |
| BCMA CAR | 6900 | SEQ ID NO. 59 in WO2015158671A1 |
| BCMA CAR | 6901 | SEQ ID NO. 19 in WO2015158671A1 |
| BCMA CAR | 6902 | SEQ ID NO. 20 in WO2015158671A1 |
| BCMA CAR | 6903 | SEQ ID NO. 21 in WO2015158671A1 |
| BCMA CAR | 6904 | SEQ ID NO. 22 in WO2015158671A1 |
| BCMA CAR | 6905 | SEQ ID NO. 23 in WO2015158671A1 |

TABLE 16-continued

| CAR sequences | | |
|---|---|---|
| Description | SEQ ID NO | Source |
| BCMA CAR | 6906 | SEQ ID NO. 24 in WO2015158671A1 |
| BCMA CAR | 6907 | SEQ ID NO. 25 in WO2015158671A1 |
| BCMA CAR | 6908 | SEQ ID NO. 26 in WO2015158671A1 |
| BCMA CAR | 6909 | SEQ ID NO. 27 in WO2015158671A1 |
| BCMA CAR | 6910 | SEQ ID NO. 28 in WO2015158671A1 |
| BCMA CAR | 6911 | SEQ ID NO. 29 in WO2015158671A1 |
| BCMA CAR | 6912 | SEQ ID NO. 30 in WO2015158671A1 |
| BCMA CAR | 6913 | SEQ ID NO. 31 in WO2015158671A1 |
| BCMA CAR | 6914 | SEQ ID NO. 32 in WO2015158671A1 |
| BCMA CAR | 6915 | SEQ ID NO. 33 in WO2015158671A1 |
| BCMA CAR | 6916 | SEQ ID NO. 34 in WO2015158671A1 |
| BCMA CAR | 6917 | SEQ ID NO. 35 in WO2015158671A1 |
| BCMA CAR | 6918 | SEQ ID NO. 36 in WO2015158671A1 |
| BCMA CAR | 6919 | SEQ ID NO. 37 in WO2015158671A1 |
| BCMA CAR | 6920 | SEQ ID NO. 38 in WO2015158671A1 |
| BCMA CAR | 6921 | SEQ ID NO. 39 in WO2015158671A1 |
| BCMA CAR | 6922 | SEQ ID NO. 40 in WO2015158671A1 |
| BCMA CAR | 6923 | SEQ ID NO. 41 in WO2015158671A1 |
| BCMA CAR | 6924 | SEQ ID NO. 42 in WO2015158671A1 |
| BCMA CAR | 6925 | SEQ ID NO: 330 in WO2016168595A1 |
| BCMA CAR | 6926 | SEQ ID NO: 282 in WO2016168595A1 |
| BCMA CAR | 6927 | SEQ ID NO: 300 in WO2016168595A1 |
| BCMA CAR | 6928 | SEQ ID NO: 306 in WO2016168595A1 |
| BCMA CAR | 6929 | SEQ ID NO. 336 in WO2016168595A1 |
| BCMA CAR | 6930 | SEQ ID NO: 354 in WO2016168595A1 |
| BCMA CAR | 6931 | SEQ ID NO: 288 in WO2016168595A1 |
| BCMA CAR | 6932 | SEQ ID NO: 312 in WO2016168595A1 |
| BCMA CAR | 6933 | SEQ ID NO: 294 in WO2016168595A1 |
| BCMA CAR | 6934 | SEQ ID NO. 342 in WO2016168595A1 |
| BCMA CAR | 6935 | SEQ ID NO. 324 in WO2016168595A1 |
| BCMA CAR | 6936 | SEQ ID NO: 318 in WO2016168595A1 |
| BCMA CAR | 6937 | SEQ ID NO: 348 in WO2016168595A1 |
| BCMA CAR | 6938 | SEQ ID NO. 124 (WO2016014565) |
| BCMA CAR | 6939 | SEQ ID NO. 114 (WO2016014565) |
| BCMA CAR | 6940 | SEQ ID NO. 115 (WO2016014565) |
| BCMA CAR | 6941 | SEQ ID NO. 116 (WO2016014565) |
| BCMA CAR | 6942 | SEQ ID NO. 117 (WO2016014565) |
| BCMA CAR | 6943 | SEQ ID NO. 118 (WO2016014565) |
| BCMA CAR | 6944 | SEQ ID NO. 119 (WO2016014565) |
| BCMA CAR | 6945 | SEQ ID NO. 120 (WO2016014565) |
| BCMA CAR | 6946 | SEQ ID NO. 121 (WO2016014565) |
| BCMA CAR | 6947 | SEQ ID NO. 122 (WO2016014565) |
| BCMA CAR | 6948 | SEQ ID NO. 123 (WO2016014565) |
| BCMA CAR | 6949 | SEQ ID NO. 125 (WO2016014565) |
| BCMA CAR | 6950 | SEQ ID NO. 126 (WO2016014565) |
| BCMA CAR | 6951 | SEQ ID NO. 127 (WO2016014565) |
| BCMA CAR | 6952 | SEQ ID NO. 128 (WO2016014565) |
| BCMA CAR | 6953 | SEQ ID NO. 234 (WO2016014565) |
| BCMA CAR | 6954 | SEQ ID NO. 235 (WO2016014565) |
| BCMA CAR | 6955 | SEQ ID NO. 236 (WO2016014565) |
| BCMA CAR | 6956 | SEQ ID NO. 237 (WO2016014565) |
| BCMA CAR | 6957 | SEQ ID NO. 238 (WO2016014565) |
| BCMA CAR | 6958 | SEQ ID NO. 239 (WO2016014565) |
| BCMA CAR | 6959 | SEQ ID NO. 240 (WO2016014565) |
| BCMA CAR | 6960 | SEQ ID NO. 241 (WO2016014565) |
| BCMA CAR | 6961 | SEQ ID NO. 242 (WO2016014565) |
| BCMA CAR | 6962 | SEQ ID NO. 243 (WO2016014565) |
| BCMA CAR | 6963 | SEQ ID NO. 244 (WO2016014565) |
| BCMA CAR | 6964 | SEQ ID NO. 245 (WO2016014565) |
| BCMA CAR | 6965 | SEQ ID NO. 246 (WO2016014565) |
| BCMA CAR | 6966 | SEQ ID NO. 247 (WO2016014565) |
| BCMA CAR | 6967 | SEQ ID NO. 248 (WO2016014565) |
| BCMA CAR | 6968 | SEQ ID NO. 249 (WO2016014565) |
| BCMA CAR | 6969 | SEQ ID NO. 250 (WO2016014565) |
| BCMA CAR | 6970 | SEQ ID NO. 251 (WO2016014565) |
| BCMA CAR | 6971 | SEQ ID NO. 252 (WO2016014565) |
| BCMA CAR | 6972 | SEQ ID NO. 253 (WO2016014565) |
| BCMA CAR | 6973 | SEQ ID NO. 254 (WO2016014565) |
| BCMA CAR | 6974 | SEQ ID NO. 267 (WO2016014565) |
| BCMA CAR | 6975 | SEQ ID NO. 268 (WO2016014565) |
| BCMA CAR | 6976 | SEQ ID NO. 269 (WO2016014565) |
| BCMA CAR | 6977 | SEQ ID NO. 270 (WO2016014565) |
| BCMA CAR | 6978 | SEQ ID NO. 1 in WO2015052538 |
| BCMA CAR | 6979 | SEQ ID NO. 2 in WO2015052538 |
| BCMA CAR | 6980 | SEQ ID NO. 3 in WO2015052538 |
| BCMA CAR | 6981 | SEQ ID NO. 4 in WO2015052538 |

TABLE 16-continued

CAR sequences

| Description | SEQ ID NO | Source |
|---|---|---|
| BCMA CAR | 6982 | SEQ ID NO. 5 in WO2015052538 |
| BCMA CAR | 6983 | SEQ ID NO. 20 in WO2015052538 |
| BCMA CAR | 6984 | SEQ ID No. 1 in US20160237139A1 |
| BCMA CAR | 6985 | SEQ ID No. 2 in US20160237139A1 |
| BCMA CAR | 6986 | SEQ ID No. 3 in US20160237139A1 |
| BCMA CAR | 6987 | SEQ ID No. 4 in US20160237139A1 |
| BCMA CAR | 6988 | SEQ ID No. 5 in US20160237139A1 |
| BCMA CAR | 6989 | SEQ ID No. 6 in US20160237139A1 |
| BCMA CAR | 6990 | SEQ ID NO: 9 in WO2016094304A3 |
| BCMA CAR | 6991 | SEQ ID NO. 4 in WO2013154760 |
| BCMA CAR | 6992 | SEQ ID NO. 5 in WO2013154760 |
| BCMA CAR | 6993 | SEQ ID NO. 6 in WO2013154760 |
| BCMA CAR | 6994 | SEQ ID NO. 8 in WO2013154760 |
| BCMA CAR | 6995 | SEQ ID NO. 9 in WO2013154760 |
| BCMA CAR | 6996 | SEQ ID NO. 10 in WO2013154760 |
| BCMA CAR | 6997 | SEQ ID NO. 11 in WO2013154760 |
| BCMA CAR | 6998 | SEQ ID NO. 12 in WO2013154760 |
| BCMA CAR | 6999 | SEQ ID NO. 15 in WO2016014789 |
| BCMA CAR | 7000 | SEQ ID NO. 16 in WO2016014789 |
| BCMA CAR | 7001 | SEQ ID NO. 17 in WO2016014789 |
| BCMA CAR | 7002 | SEQ ID NO. 18 in WO2016014789 |
| BCMA CAR | 7003 | SEQ ID NO. 19 in WO2016014789 |
| BCMA CAR | 7004 | SEQ ID NO. 20 in WO2016014789 |
| BCMA CAR | 7005 | SEQ ID NO. 21 in WO2016014789 |
| BCMA CAR | 7006 | SEQ ID NO. 22 in WO2016014789 |
| BCMA CAR | 7007 | SEQ ID NO. 23 in WO2016014789 |
| BCMA CAR | 7008 | SEQ ID NO. 24 in WO2016014789 |
| BCMA CAR | 7009 | SEQ ID NO. 25 in WO2016014789 |
| BCMA CAR | 7010 | SEQ ID NO. 26 in WO2016014789 |
| BCMA CAR | 7011 | SEQ ID NO. 27 in WO2016014789 |
| BCMA CAR | 7012 | SEQ ID NO. 28 in WO2016014789 |
| BCMA CAR | 7013 | SEQ ID NO. 29 in WO2016014789 |
| BCMA CAR | 7014 | SEQ ID NO. 71 in WO2016014789 |
| BCMA CAR | 7015 | SEQ ID NO. 73 in WO2016014789 |
| BCMA CAR | 7016 | SEQ ID NO. 125 in WO2016120216 |
| BCMA CAR | 7017 | SEQ ID NO. 126 in WO2016120216 |
| BCMA CAR | 7018 | SEQ ID NO. 127 in WO2016120216 |
| BCMA CAR | 7019 | SEQ ID NO. 128 in WO2016120216 |
| BCMA CAR | 7020 | SEQ ID NO. 129 in WO2016120216 |
| BCMA CAR | 7021 | SEQ ID NO. 130 in WO2016120216 |
| BCMA CAR | 7022 | SEQ ID NO. 131 in WO2016120216 |
| BCMA CAR | 7023 | SEQ ID NO. 132 in WO2016120216 |
| BCMA CAR | 7024 | SEQ ID NO. 133 in WO2016120216 |
| BCMA CAR | 7025 | SEQ ID NO. 134 in WO2016120216 |
| BCMA CAR | 7026 | SEQ ID NO. 135 in WO2016120216 |
| BCMA CAR | 7027 | SEQ ID NO. 136 in WO2016120216 |
| BCMA CAR | 7028 | SEQ ID NO. 137 in WO2016120216 |
| BCMA CAR | 7029 | SEQ ID NO. 138 in WO2016120216 |
| BCMA CAR | 7030 | SEQ ID NO. 139 in WO2016120216 |
| BCMA CAR | 7031 | SEQ ID NO. 140 in WO2016120216 |
| BCMA CAR | 7032 | SEQ ID NO. 141 in WO2016120216 |
| BCMA CAR | 7033 | SEQ ID NO. 145 in WO2016120216 |
| BCMA CAR | 7034 | SEQ ID NO. 146 in WO2016120216 |
| BCMA CAR | 7035 | SEQ ID NO. 147 in WO2016120216 |
| BCMA CAR | 7036 | SEQ ID NO. 148 in WO2016120216 |
| BCMA CAR | 7037 | SEQ ID NO. 149 in WO2016120216 |
| BCMA CAR | 7038 | SEQ ID NO. 150 in WO2016120216 |
| BCMA NCAR | 7039 | SEQ ID NO: 102 in WO2016097231 |
| BCMA NCAR | 7040 | SEQ ID NO: 106 in WO2016097231 |
| BCMA NCAR | 7041 | SEQ ID NO: 107 in WO2016097231 |
| BCMA NCAR | 7042 | SEQ ID NO: 108 in WO2016097231 |
| BCMA NCAR | 7043 | SEQ ID NO: 109 in WO2016097231 |
| BCMA NCAR | 7044 | SEQ ID NO: 110 in WO2016097231 |
| BCMA NCAR | 7045 | SEQ ID NO: 111 in WO2016097231 |
| BCMA NCAR | 7046 | SEQ ID NO: 112 in WO2016097231 |
| BCMA NCAR | 7047 | SEQ ID NO: 129 in WO2016097231 |
| BCMA NCAR | 7048 | SEQ ID NO: 130 in WO2016097231 |
| BCMA NCAR | 7049 | SEQ ID NO: 131 in WO2016097231 |
| BCMA NCAR | 7050 | SEQ ID NO: 132 in WO2016097231 |
| BCMA NCAR | 7051 | SEQ ID NO: 133 in WO2016097231 |
| BCMA NCAR | 7052 | SEQ ID NO: 134 in WO2016097231 |
| BCMA NCAR | 7053 | SEQ ID NO: 135 in WO2016097231 |
| BCMA NCAR | 7054 | SEQ ID NO: 136 in WO2016097231 |
| BCMA NCAR | 7055 | SEQ ID NO: 113 in WO2016097231 |
| BCMA NCAR | 7056 | SEQ ID NO: 114 in WO2016097231 |
| BCMA NCAR | 7057 | SEQ ID NO: 115 in WO2016097231 |

TABLE 16-continued

CAR sequences

| Description | SEQ ID NO | Source |
|---|---|---|
| BCMA NCAR | 7058 | SEQ ID NO: 116 in WO2016097231 |
| BCMA NCAR | 7059 | SEQ ID NO: 117 in WO2016097231 |
| BCMA NCAR | 7060 | SEQ ID NO: 118 in WO2016097231 |
| BCMA NCAR | 7061 | SEQ ID NO: 101 in WO2016097231 |
| BCMA NCAR | 7062 | SEQ ID NO: 100 in WO2016097231 |
| BCMA NCAR | 7063 | SEQ ID NO: 137 in WO2016097231 |
| BCMA NCAR | 7064 | SEQ ID NO: 119 in WO2016097231 |
| BCMA NCAR | 7065 | SEQ ID NO: 120 in WO2016097231 |
| BCMA NCAR | 7066 | SEQ ID NO: 121 in WO2016097231 |
| BCMA NCAR | 7067 | SEQ ID NO: 122 in WO2016097231 |
| BCMA NCAR | 7068 | SEQ ID NO: 123 in WO2016097231 |
| BCMA NCAR | 7069 | SEQ ID NO: 124 in WO2016097231 |
| BCMA NCAR | 7070 | SEQ ID NO: 125 in WO2016097231 |
| BCMA NCAR | 7071 | SEQ ID NO: 126 in WO2016097231 |
| BCMA NCAR | 7072 | SEQ ID NO: 127 in WO2016097231 |
| BCMA NCAR | 7073 | SEQ ID NO: 128 in WO2016097231 |
| BCMA NCAR | 7074 | SEQ ID NO: 103 in WO2016097231 |
| BCMA NCAR | 7075 | SEQ ID NO: 104 in WO2016097231 |
| BCMA NCAR | 7076 | SEQ ID NO: 105 in WO2016097231 |
| BCMA NCAR | 7077 | SEQ ID NO: 213 in WO2016097231 |
| CAR | 7078 | SEQ ID NO: 6 in US20160296562A1 |
| CAR AND gate (CD19 AND CD33) CD148 phosphatase | 7079 | SEQ ID NO: 2 in US20160296562A1 |
| CAR AND gate (CD19 AND CD5) | 7080 | SEQ ID NO: 43 in US20160296562A1 |
| CAR AND gate (CD19 AND EGFRvIII) | 7081 | SEQ ID NO: 45 in US20160296562A1 |
| CAR AND gate (CD19 AND GD2) | 7082 | SEQ ID NO: 41 in US20160296562A1 |
| CAR AND gate (CD19 OR CD33) CD45 phosphatase | 7083 | SEQ ID NO: 3 in US20160296562A1 |
| CAR AND NOT gate (CD19 AND NOT CD33) | 7084 | SEQ ID NO: 4 in US20160296562A1 |
| CAR AND NOT gate (CD19 AND NOT CD33) | 7085 | SEQ ID NO: 5 in US20160296562A1 |
| CAR AND NOT gate 1 | 7086 | SEQ ID NO: 48 in US20160296562A1 |
| CAR AND NOT gate 2 | 7087 | SEQ ID NO: 49 in US20160296562A1 |
| CAR AND NOT gate 3 | 7088 | SEQ ID NO: 50 in US20160296562A1 |
| CAR OR gate (CD19 OR CD33) | 7089 | SEQ ID NO: 1 in US20160296562A1 |
| CAT19 CAR with a CD28Zeta endodomain | 7090 | SEQ ID NO. 12 in WO2016139487 |
| CAT19 CAR with an OX40Zeta endodomain | 7091 | SEQ ID NO. 11 in WO2016139487 |
| CAT19 chimeric gen receptor (CAR) using Campana architecture | 7092 | SEQ ID NO. 10 in WO2016139487 |
| CD123 CAR | 7093 | SEQ ID NO. 69 in WO2016142532 |
| CD123 CAR | 7094 | SEQ ID NO. 23 in WO2015140268A1 |
| CD123 CAR | 7095 | SEQ ID NO. 24 in WO2015140268A1 |
| CD123 CAR | 7096 | SEQ ID NO. 25 in WO2015140268A1 |
| CD123 CAR | 7097 | SEQ ID NO. 26 in WO2015140268A1 |
| CD123 CAR | 7098 | SEQ ID NO. 27 in WO2015140268A1 |
| CD123 CAR | 7099 | SEQ ID NO. 28 in WO2015140268A1 |
| CD123 CAR | 7100 | SEQ ID NO. 29 in WO2015140268A1 |
| CD123 CAR | 7101 | SEQ ID NO. 30 in WO2015140268A1 |
| CD123 CAR | 7102 | SEQ ID NO. 31 in WO2015140268A1 |
| CD123 CAR | 7103 | SEQ ID NO. 32 in WO2015140268A1 |
| CD123 CAR | 7104 | SEQ ID NO. 33 in WO2015140268A1 |
| CD123 CAR | 7105 | SEQ ID NO. 34 in WO2015140268A1 |
| CD123 CAR | 7106 | SEQ ID NO. 35 in WO2015140268A1 |
| CD123 CAR | 7107 | SEQ ID NO. 36 in WO2015140268A1 |
| CD123 CAR | 7108 | SEQ ID NO. 37 in WO2015140268A1 |
| CD123 CAR | 7109 | SEQ ID NO. 38 in WO2015140268A1 |
| CD123 CAR | 7110 | SEQ ID NO. 39 in WO2015140268A1 |
| CD123 CAR | 7111 | SEQ ID NO. 40 in WO2015140268A1 |
| CD123 CAR | 7112 | SEQ ID NO. 41 in WO2015140268A1 |
| CD123 CAR | 7113 | SEQ ID NO. 42 in WO2015140268A1 |
| CD123 CAR | 7114 | SEQ ID NO. 43 in WO2015140268A1 |
| CD123 CAR | 7115 | SEQ ID NO. 44 in WO2015140268A1 |
| CD123 CAR | 7116 | SEQ ID NO. 45 in WO2015140268A1 |
| CD123 CAR | 7117 | SEQ ID NO. 46 in WO2015140268A1 |
| CD123 CAR | 7118 | SEQ ID NO. 47 in WO2015140268A1 |
| CD123 CAR | 7119 | SEQ ID NO. 48 in WO2015140268A1 |
| CD123 CAR | 7120 | SEQ ID NO: 9 (US20140271582) |
| CD123 CAR | 7121 | SEQ ID NO. 10 (US20140271582) |
| CD123 CAR | 7122 | SEQ ID NO. 11 (US20140271582) |
| CD123 CAR | 7123 | SEQ ID NO: 12 (US20140271582) |
| CD123 CAR | 7124 | SEQ ID NO: 56 in WO2016097231 |
| CD123 CAR | 7125 | SEQ ID NO: 57 in WO2016097231 |
| CD123 CAR | 7126 | SEQ ID NO: 58 in WO2016097231 |

TABLE 16-continued

CAR sequences

| Description | SEQ ID NO | Source |
|---|---|---|
| CD123 CAR | 7127 | SEQ ID NO: 59 in WO2016097231 |
| CD123 CAR | 7128 | SEQ ID NO: 60 in WO2016097231 |
| CD123 CAR | 7129 | SEQ ID NO: 61 in WO2016097231 |
| CD123 CAR | 7130 | SEQ ID NO. 98 in WO2016028896 |
| CD123 CAR | 7131 | SEQ ID NO. 99 in WO2016028896 |
| CD123 CAR | 7132 | SEQ ID NO. 100 in WO2016028896 |
| CD123 CAR | 7133 | SEQ ID NO. 101 in WO2016028896 |
| CD123 CAR | 7134 | SEQ ID NO. 125 in WO2016028896 |
| CD123 CAR | 7135 | SEQ ID NO. 126 in WO2016028896 |
| CD123 CAR | 7136 | SEQ ID NO. 127 in WO2016028896 |
| CD123 CAR | 7137 | SEQ ID NO. 128 in WO2016028896 |
| CD123 CAR | 7138 | SEQ ID NO. 129 in WO2016028896 |
| CD123 CAR | 7139 | SEQ ID NO. 130 in WO2016028896 |
| CD123 CAR | 7140 | SEQ ID NO. 131 in WO2016028896 |
| CD123 CAR | 7141 | SEQ ID NO. 132 in WO2016028896 |
| CD123 CAR | 7142 | SEQ ID NO. 133 in WO2016028896 |
| CD123 CAR | 7143 | SEQ ID NO. 134 in WO2016028896 |
| CD123 CAR | 7144 | SEQ ID NO. 135 in WO2016028896 |
| CD123 CAR | 7145 | SEQ ID NO. 136 in WO2016028896 |
| CD123 CAR | 7146 | SEQ ID NO. 137 in WO2016028896 |
| CD123 CAR | 7147 | SEQ ID NO. 138 in WO2016028896 |
| CD123 CAR | 7148 | SEQ ID NO. 139 in WO2016028896 |
| CD123 CAR | 7149 | SEQ ID NO. 140 in WO2016028896 |
| CD123 CAR | 7150 | SEQ ID NO. 141 in WO2016028896 |
| CD123 CAR | 7151 | SEQ ID NO. 142 in WO2016028896 |
| CD123 CAR | 7152 | SEQ ID NO. 143 in WO2016028896 |
| CD123 CAR | 7153 | SEQ ID NO. 144 in WO2016028896 |
| CD123 CAR | 7154 | SEQ ID NO. 145 in WO2016028896 |
| CD123 CAR | 7155 | SEQ ID NO. 146 in WO2016028896 |
| CD123 CAR | 7156 | SEQ ID NO. 147 in WO2016028896 |
| CD123 CAR | 7157 | SEQ ID NO. 148 in WO2016028896 |
| CD123 CAR | 7158 | SEQ ID NO. 149 in WO2016028896 |
| CD123 CAR | 7159 | SEQ ID NO. 150 in WO2016028896 |
| CD123 CAR | 7160 | SEQ ID NO. 151 in WO2016028896 |
| CD123 CAR | 7161 | SEQ ID NO. 152 in WO2016028896 |
| CD123 CAR | 7162 | SEQ ID NO. 153 in WO2016028896 |
| CD123 CAR | 7163 | SEQ ID NO. 154 in WO2016028896 |
| CD123 CAR | 7164 | SEQ ID NO. 155 in WO2016028896 |
| CD123 CAR | 7165 | SEQ ID NO. 156 in WO2016028896 |
| CD123 CAR | 7166 | SEQ ID NO. 31 in WO2016120220 |
| CD123 CAR | 7167 | SEQ ID NO. 32 in WO2016120220 |
| CD123 CAR | 7168 | SEQ ID NO. 33 in WO2016120220 |
| CD123 CAR | 7169 | SEQ ID NO. 34 in WO2016120220 |
| CD123 CAR | 7170 | SEQ ID NO. 35 in WO2016120220 |
| CD123 CAR | 7171 | SEQ ID NO. 36 in WO2016120220 |
| CD123 CAR | 7172 | SEQ ID NO. 37 in WO2016120220 |
| CD123 CAR | 7173 | SEQ ID NO. 38 in WO2016120220 |
| CD123 CAR | 7174 | SEQ ID NO. 39 in WO2016120220 |
| CD123 CAR | 7175 | SEQ ID NO. 40 in WO2016120220 |
| CD123 CAR | 7176 | SEQ ID NO. 41 in WO2016120220 |
| CD123 CAR | 7177 | SEQ ID NO. 42 in WO2016120220 |
| CD123 CAR | 7178 | SEQ ID NO. 43 in WO2016120220 |
| CD123 CAR | 7179 | SEQ ID NO. 44 in WO2016120220 |
| CD123 CAR | 7180 | SEQ ID NO. 45 in WO2016120220 |
| CD123 CAR | 7181 | SEQ ID NO. 46 in WO2016120220 |
| CD123 CAR | 7182 | SEQ ID NO. 47 in WO2016120220 |
| CD123 CAR | 7183 | SEQ ID NO. 48 in WO2016120220 |
| CD123 CAR | 7184 | SEQ ID NO. 49 in WO2016120220 |
| CD123 CAR | 7185 | SEQ ID NO. 50 in WO2016120220 |
| CD123 CAR | 7186 | SEQ ID NO. 51 in WO2016120220 |
| CD123 CAR | 7187 | SEQ ID NO. 52 in WO2016120220 |
| CD123 CAR | 7188 | SEQ ID NO. 53 in WO2016120220 |
| CD123 CAR | 7189 | SEQ ID NO. 54 in WO2016120220 |
| CD123 CAR | 7190 | SEQ ID NO. 55 in WO2016120220 |
| CD123 CAR | 7191 | SEQ ID NO. 56 in WO2016120220 |
| CD123 CAR | 7192 | SEQ ID NO. 57 in WO2016120220 |
| CD123 CAR | 7193 | SEQ ID NO. 58 in WO2016120220 |
| CD123 CAR | 7194 | SEQ ID NO. 59 in WO2016120220 |
| CD123 CAR | 7195 | SEQ ID NO. 60 in WO2016120220 |
| CD123 CAR | 7196 | SEQ ID NO. 61 in WO2016120220 |
| CD123 CAR | 7197 | SEQ ID NO. 62 in WO2016120220 |
| CD123 CAR | 7198 | SEQ ID NO. 63 in WO2016120220 |
| CD123 CAR | 7199 | SEQ ID NO. 64 in WO2016120220 |
| CD123 CAR | 7200 | SEQ ID NO. 65 in WO2016120220 |
| CD123 CAR | 7201 | SEQ ID NO. 66 in WO2016120220 |
| CD123 CAR | 7202 | SEQ ID NO. 67 in WO2016120220 |

TABLE 16-continued

CAR sequences

| Description | SEQ ID NO | Source |
|---|---|---|
| CD123 CAR | 7203 | SEQ ID NO. 68 in WO2016120220 |
| CD123 CAR | 7204 | SEQ ID NO. 69 in WO2016120220 |
| CD123 CAR | 7205 | SEQ ID NO. 70 in WO2016120220 |
| CD123 CAR | 7206 | SEQ ID NO. 71 in WO2016120220 |
| CD123 CAR | 7207 | SEQ ID NO. 72 in WO2016120220 |
| CD123 CAR | 7208 | SEQ ID NO. 73 in WO2016120220 |
| CD123 CAR | 7209 | SEQ ID NO. 74 in WO2016120220 |
| CD123 CAR | 7210 | SEQ ID NO. 75 in WO2016120220 |
| CD123 CAR | 7211 | SEQ ID NO. 76 in WO2016120220 |
| CD123 CAR | 7212 | SEQ ID NO. 77 in WO2016120220 |
| CD123 CAR | 7213 | SEQ ID NO. 78 in WO2016120220 |
| CD123 CAR | 7214 | SEQ ID NO. 79 in WO2016120220 |
| CD123 CAR | 7215 | SEQ ID NO. 80 in WO2016120220 |
| CD123 CAR | 7216 | SEQ ID NO. 81 in WO2016120220 |
| CD123 CAR | 7217 | SEQ ID NO. 82 in WO2016120220 |
| CD123 CAR | 7218 | SEQ ID NO. 83 in WO2016120220 |
| CD123 CAR | 7219 | SEQ ID NO. 84 in WO2016120220 |
| CD123 CAR | 7220 | SEQ ID NO. 85 in WO2016120220 |
| CD123 CAR | 7221 | SEQ ID NO. 86 in WO2016120220 |
| CD123 CAR | 7222 | SEQ ID NO. 87 in WO2016120220 |
| CD123 CAR | 7223 | SEQ ID NO. 88 in WO2016120220 |
| CD123 CAR | 7224 | SEQ ID NO. 89 in WO2016120220 |
| CD123 CAR | 7225 | SEQ ID NO. 90 in WO2016120220 |
| CD123 CAR | 7226 | SEQ ID NO. 91 in WO2016120220 |
| CD123 CAR | 7227 | SEQ ID NO. 92 in WO2016120220 |
| CD123 CAR | 7228 | SEQ ID NO. 93 in WO2016120220 |
| CD123 CAR | 7229 | SEQ ID NO. 94 in WO2016120220 |
| CD123 CAR | 7230 | SEQ ID NO. 95 in WO2016120220 |
| CD123 CAR | 7231 | SEQ ID NO. 96 in WO2016120220 |
| CD123 CAR | 7232 | SEQ ID NO. 97 in WO2016120220 |
| CD123 CAR | 7233 | SEQ ID NO. 98 in WO2016120220 |
| CD123 CAR | 7234 | SEQ ID NO. 99 in WO2016120220 |
| CD123 CAR | 7235 | SEQ ID NO. 100 in WO2016120220 |
| CD123 CAR | 7236 | SEQ ID NO. 101 in WO2016120220 |
| CD123 CAR | 7237 | SEQ ID NO. 102 in WO2016120220 |
| CD123 CAR | 7238 | SEQ ID NO. 103 in WO2016120220 |
| CD123 CAR | 7239 | SEQ ID NO. 104 in WO2016120220 |
| CD123 CAR | 7240 | SEQ ID NO. 105 in WO2016120220 |
| CD123 CAR | 7241 | SEQ ID NO. 106 in WO2016120220 |
| CD123 CAR | 7242 | SEQ ID NO. 107 in WO2016120220 |
| CD123 CAR | 7243 | SEQ ID NO. 108 in WO2016120220 |
| CD123 CAR | 7244 | SEQ ID NO. 109 in WO2016120220 |
| CD123 CAR | 7245 | SEQ ID NO. 110 in WO2016120220 |
| CD123 CAR | 7246 | SEQ ID NO. 111 in WO2016120220 |
| CD123 CAR | 7247 | SEQ ID NO. 112 in WO2016120220 |
| CD123 CAR | 7248 | SEQ ID NO. 113 in WO2016120220 |
| CD123 CAR | 7249 | SEQ ID NO. 114 in WO2016120220 |
| CD123 CAR | 7250 | SEQ ID NO. 115 in WO2016120220 |
| CD123 CAR | 7251 | SEQ ID NO. 116 in WO2016120220 |
| CD123 CAR | 7252 | SEQ ID NO. 117 in WO2016120220 |
| CD123 CAR | 7253 | SEQ ID NO. 118 in WO2016120220 |
| CD123 CAR | 7254 | SEQ ID NO. 119 in WO2016120220 |
| CD123 CAR | 7255 | SEQ ID NO. 120 in WO2016120220 |
| CD123 CAR | 7256 | SEQ ID NO. 121 in WO2016120220 |
| CD123 CAR | 7257 | SEQ ID NO. 122 in WO2016120220 |
| CD123 CAR | 7258 | SEQ ID NO. 123 in WO2016120220 |
| CD123 CAR | 7259 | SEQ ID NO. 124 in WO2016120220 |
| CD123 CAR | 7260 | SEQ ID NO. 125 in WO2016120220 |
| CD123 CAR | 7261 | SEQ ID NO. 126 in WO2016120220 |
| CD123 CAR | 7262 | SEQ ID NO. 127 in WO2016120220 |
| CD123 CAR | 7263 | SEQ ID NO. 128 in WO2016120220 |
| CD123 CAR | 7264 | SEQ ID NO. 129 in WO2016120220 |
| CD123 CAR | 7265 | SEQ ID NO. 130 in WO2016120220 |
| CD123 CAR | 7266 | SEQ ID NO. 131 in WO2016120220 |
| CD123 CAR | 7267 | SEQ ID NO. 132 in WO2016120220 |
| CD123 CAR | 7268 | SEQ ID NO. 133 in WO2016120220 |
| CD123 CAR | 7269 | SEQ ID NO. 134 in WO2016120220 |
| CD123 CAR | 7270 | SEQ ID NO. 135 in WO2016120220 |
| CD123 CAR | 7271 | SEQ ID NO. 136 in WO2016120220 |
| CD123 CAR | 7272 | SEQ ID NO. 137 in WO2016120220 |
| CD123 CAR | 7273 | SEQ ID NO. 138 in WO2016120220 |
| CD123 CAR | 7274 | SEQ ID NO. 139 in WO2016120220 |
| CD123 CAR | 7275 | SEQ ID NO. 140 in WO2016120220 |
| CD123 CAR | 7276 | SEQ ID NO. 141 in WO2016120220 |
| CD123 CAR | 7277 | SEQ ID NO. 142 in WO2016120220 |
| CD123 CAR | 7278 | SEQ ID NO. 143 in WO2016120220 |

TABLE 16-continued

CAR sequences

| Description | SEQ ID NO | Source |
|---|---|---|
| CD123 CAR | 7279 | SEQ ID NO. 144 in WO2016120220 |
| CD123 CAR | 7280 | SEQ ID NO. 145 in WO2016120220 |
| CD123 CAR | 7281 | SEQ ID NO. 146 in WO2016120220 |
| CD123 CAR | 7282 | SEQ ID NO. 147 in WO2016120220 |
| CD123 CAR | 7283 | SEQ ID NO. 148 in WO2016120220 |
| CD123 CAR | 7284 | SEQ ID NO. 149 in WO2016120220 |
| CD123 CAR | 7285 | SEQ ID NO. 150 in WO2016120220 |
| CD123 CAR | 7286 | SEQ ID NO. 151 in WO2016120220 |
| CD123 CAR | 7287 | SEQ ID NO. 152 in WO2016120220 |
| CD123 CAR | 7288 | SEQ ID NO. 153 in WO2016120220 |
| CD123 CAR | 7289 | SEQ ID NO. 154 in WO2016120220 |
| CD123 CAR | 7290 | SEQ ID NO. 155 in WO2016120220 |
| CD123 CAR | 7291 | SEQ ID NO. 156 in WO2016120220 |
| CD123 CAR | 7292 | SEQ ID NO. 157 in WO2016120220 |
| CD123 CAR | 7293 | SEQ ID NO. 158 in WO2016120220 |
| CD123 CAR | 7294 | SEQ ID NO. 159 in WO2016120220 |
| CD123 CAR | 7295 | SEQ ID NO. 160 in WO2016120220 |
| CD123 CAR | 7296 | SEQ ID NO. 172 in WO2016120220 |
| CD123 CAR | 7297 | SEQ ID NO. 173 in WO2016120220 |
| CD123 CAR | 7298 | SEQ ID NO. 174 in WO2016120220 |
| CD123 CAR | 7299 | SEQ ID NO. 175 in WO2016120220 |
| CD123 CAR | 7300 | SEQ ID NO. 176 in WO2016120220 |
| CD123 CAR | 7301 | SEQ ID NO. 177 in WO2016120220 |
| CD123 CAR | 7302 | SEQ ID NO. 178 in WO2016120220 |
| CD123 CAR | 7303 | SEQ ID NO. 179 in WO2016120220 |
| CD123 CAR | 7304 | SEQ ID NO. 180 in WO2016120220 |
| CD123 CAR | 7305 | SEQ ID NO. 181 in WO2016120220 |
| CD123 CAR | 7306 | SEQ ID NO. 182 in WO2016120220 |
| CD123 CAR | 7307 | SEQ ID NO. 183 in WO2016120220 |
| CD123 CAR | 7308 | SEQ ID NO. 184 in WO2016120220 |
| CD123 CAR | 7309 | SEQ ID NO. 185 in WO2016120220 |
| CD123 CAR | 7310 | SEQ ID NO. 186 in WO20I6120220 |
| CD123 CAR | 7311 | SEQ ID NO. 187 in WO2016120220 |
| CD123 CAR | 7312 | SEQ ID NO. 188 in WO2016120220 |
| CD123 CAR | 7313 | SEQ ID NO. 189 in WO2016120220 |
| CD123 CAR | 7314 | SEQ ID NO. 190 in WO2016120220 |
| CD123 CAR | 7315 | SEQ ID NO. 191 in WO2016120220 |
| CD123 CAR | 7316 | SEQ ID NO. 192 in WO2016120220 |
| CD123 CAR | 7317 | SEQ ID NO. 193 in WO2016120220 |
| CD123 CAR | 7318 | SEQ ID NO. 194 in WO2016120220 |
| CD123 CAR | 7319 | SEQ ID NO. 195 in WO2016120220 |
| CD123 CAR | 7320 | SEQ ID NO. 196 in WO2016120220 |
| CD123 CAR | 7321 | SEQ ID NO. 197 in WO2016120220 |
| CD123 CAR | 7322 | SEQ ID NO. 1 in WO2016120216 |
| CD123 CAR | 7323 | SEQ ID NO. 2 in WO2016120216 |
| CD123 CAR | 7324 | SEQ ID NO. 3 in WO2016120216 |
| CD123 CAR | 7325 | SEQ ID NO. 4 in WO2016120216 |
| CD123 CAR | 7326 | SEQ ID NO. 5 in WO2016120216 |
| CD123 CAR | 7327 | SEQ ID NO. 6 in WO2016120216 |
| CD123 CAR | 7328 | SEQ ID NO. 7 in WO2016120216 |
| CD123 CAR | 7329 | SEQ ID NO. 8 in WO2016120216 |
| CD123 CAR | 7330 | SEQ ID NO. 9 in WO2016120216 |
| CD123 CAR | 7331 | SEQ ID NO. 10 in WO2016120216 |
| CD123 CAR | 7332 | SEQ ID NO. 142 in WO2016120216 |
| CD19/IL13 Bispecific CAR | 7333 | SEQ ID NO: 10 in US20160340649A1 |
| CD19 CAR | 7334 | SEQ ID NO: 12 in U.S. Pat. No. 9,499,629B2 |
| CD19 CAR | 7335 | SEQ ID NO: 24 in US20160333108A1 |
| CD19 CAR | 7336 | SEQ ID NO: 25 in US20160333108A1 |
| CD19 CAR | 7337 | SEQ ID NO: 26 in US20160333108A1 |
| CD19 CAR | 7338 | SEQ ID NO: 27 in US20160333108A1 |
| CD19 CAR | 7339 | SEQ ID NO: 1 in EP2997134A4 |
| CD19 CAR | 7340 | SEQ ID NO: 19 in EP3071687A1 |
| CD19 CAR | 7341 | SEQ ID NO: 20 in EP3071687A1 |
| CD19 CAR | 7342 | SEQ ID NO: 181 in WO2016168773A3 |
| CD19 CAR | 7343 | SEQ ID NO: 2 in WO2015157399A9 |
| CD19 CAR | 7344 | SEQ ID NO: 56 in WO2016174409A1 |
| CD19 CAR | 7345 | SEQ ID NO: 62 in WO2016174409A1 |
| CD19 CAR | 7346 | SEQ ID NO: 145 in WO2016179319A1 |
| CD19 CAR | 7347 | SEQ ID NO: 293 in US20160311907A1 |
| CD19 CAR | 7348 | SEQ ID NO: 294 in US20160311907A1 |
| CD19 CAR | 7349 | SEQ ID NO: 295 in US20160311907A1 |
| CD19 CAR | 7350 | SEQ ID NO: 296 in US20160311907A1 |
| CD19 CAR | 7351 | SEQ ID NO: 297 in US20160311907A1 |
| CD19 CAR | 7352 | SEQ ID NO: 298 in US20160311907A1 |
| CD19 CAR | 7353 | SEQ ID NO. 73 in WO2013176915A1 |
| CD19 CAR | 7354 | SEQ ID NO. 73 in WO2013176916A1 |

TABLE 16-continued

CAR sequences

| Description | SEQ ID NO | Source |
| --- | --- | --- |
| CD19 CAR | 7355 | SEQ ID NO. 73 in US20130315884A1 |
| CD19 CAR | 7356 | SEQ ID NO. 73 in US20140134142A1 |
| CD19 CAR | 7357 | SEQ ID NO. 73 in US20150017136A1 |
| CD19 CAR | 7358 | SEQ ID NO. 73 in US20150203817A1 |
| CD19 CAR | 7359 | SEQ ID NO. 73 in US20160120905A1 |
| CD19 CAR | 7360 | SEQ ID NO. 73 in US20160120906A1 |
| CD19 CAR | 7361 | SEQ ID NO. 8 in WO2015124715 |
| CD19 CAR | 7362 | SEQ ID NO. 5 in WO2015124715 |
| CD19 CAR | 7363 | SEQ ID NO. 73 in WO2014184744 |
| CD19 CAR | 7364 | SEQ ID NO. 73 in WO2014184741 |
| CD19 CAR | 7365 | SEQ ID NO. 14 in US20160145337A1 |
| CD19 CAR | 7366 | SEQ ID NO. 15 in US20160145337A1 |
| CD19 CAR | 7367 | SEQ ID NO. 14 in WO2014184143 |
| CD19 CAR | 7368 | SEQ ID NO. 15 in WO2014184143 |
| CD19 CAR | 7369 | SEQ ID NO. 15 in WO2015075175 |
| CD19 CAR | 7370 | SEQ ID NO. 16 in WO2015075175 |
| CD19 CAR | 7371 | SEQ ID NO. 16 in US20160145337A1 |
| CD19 CAR | 7372 | SEQ ID NO. 16 in WO2014184143 |
| CD19 CAR | 7373 | SEQ ID NO 12 in WO2012079000 |
| CD19 CAR | 7374 | SEQ ID NO. 31 in WO2016164580 |
| CD19 CAR | 7375 | SEQ ID NO. 32 in WO2016164580 |
| CD19 CAR | 7376 | SEQ ID NO. 33 in WO2016164580 |
| CD19 CAR | 7377 | SEQ ID NO. 34 in WO2016164580 |
| CD19 CAR | 7378 | SEQ ID NO. 35 in WO2016164580 |
| CD19 CAR | 7379 | SEQ ID NO. 36 in WO2016164580 |
| CD19 CAR | 7380 | SEQ ID NO. 37 in WO2016164580 |
| CD19 CAR | 7381 | SEQ ID NO. 38 in WO2016164580 |
| CD19 CAR | 7382 | SEQ ID NO. 39 in WO2016164580 |
| CD19 CAR | 7383 | SEQ ID NO. 40 in WO2016164580 |
| CD19 CAR | 7384 | SEQ ID NO. 41 in WO2016164580 |
| CD19 CAR | 7385 | SEQ ID NO. 42 in WO2016164580 |
| CD19 CAR | 7386 | SEQ ID NO. 58 in WO2016164580 |
| CD19 CAR | 7387 | SEQ ID NO: 14 in US20160296563A1 |
| CD19 CAR | 7388 | SEQ ID NO: 15 in US20160296563A1 |
| CD19 CAR | 7389 | SEQ ID NO. 31 in WO2015157252 |
| CD19 CAR | 7390 | SEQ ID NO. 32 in WO2015157252 |
| CD19 CAR | 7391 | SEQ ID NO. 33 in WO2015157252 |
| CD19 CAR | 7392 | SEQ ID NO. 34 in WO2015157252 |
| CD19 CAR | 7393 | SEQ ID NO. 35 in WO2015157252 |
| CD19 CAR | 7394 | SEQ ID NO. 36 in WO2015157252 |
| CD19 CAR | 7395 | SEQ ID NO. 37 in WO2015157252 |
| CD19 CAR | 7396 | SEQ ID NO. 38 in WO2015157252 |
| CD19 CAR | 7397 | SEQ ID NO. 39 in WO2015157252 |
| CD19 CAR | 7398 | SEQ ID NO. 40 in WO2015157252 |
| CD19 CAR | 7399 | SEQ ID NO. 41 in WO2015157252 |
| CD19 CAR | 7400 | SEQ ID NO. 42 in WO2015157252 |
| CD19 CAR | 7401 | SEQ ID NO. 14 in WO2016139487 |
| CD19 CAR | 7402 | SEQ ID NO. 15 in WO2016139487 |
| CD19 CAR | 7403 | SEQ ID NO: 53 in US20160250258A1 |
| CD19 CAR | 7404 | SEQ ID NO: 54 in US20160250258A1 |
| CD19 CAR | 7405 | SEQ ID NO: 55 in US20160250258A1 |
| CD19 CAR | 7406 | SEQ ID NO: 56 in US20160250258A1 |
| CD19 CAR | 7407 | SEQ ID NO: 57 in US20160250258A1 |
| CD19 CAR | 7408 | SEQ ID NO: 58 in US20160250258A1 |
| CD19 CAR | 7409 | SEQ ID NO. 1 in WO2015187528 |
| CD19 CAR | 7410 | SEQ ID NO. 2 in WO2015187528 |
| CD19 CAR | 7411 | SEQ ID NO. 3 in WO2015187528 |
| CD19 CAR | 7412 | SEQ ID NO. 4 in WO2015187528 |
| CD19 CAR | 7413 | SEQ ID NO. 5 in WO2015187528 |
| CD19 CAR | 7414 | SEQ ID NO. 6 in WO2015187528 |
| CD19 CAR | 7415 | SEQ ID NO. 7 in WO2015187528 |
| CD19 CAR | 7416 | SEQ ID NO. 8 in WO2015187528 |
| CD19 CAR | 7417 | SEQ ID NO. 9 in WO2015187528 |
| CD19 CAR | 7418 | SEQ ID NO. 10 in WO2015187528 |
| CD19 CAR | 7419 | SEQ ID NO. 11 in WO2015187528 |
| CD19 CAR | 7420 | SEQ ID NO. 12 in WO2015187528 |
| CD19 CAR | 7421 | SEQ ID NO. 13 in WO2015187528 |
| CD19 CAR | 7422 | SEQ ID. NO. 31 in WO2015157252 |
| CD19 CAR | 7423 | SEQ ID. NO. 32 in WO2015157252 |
| CD19 CAR | 7424 | SEQ ID. NO. 33 in WO2015157252 |
| CD19 CAR | 7425 | SEQ ID. NO. 34 in WO2015157252 |
| CD19 CAR | 7426 | SEQ ID. NO. 35 in WO2015157252 |
| CD19 CAR | 7427 | SEQ ID. NO. 36 in WO2015157252 |
| CD19 CAR | 7428 | SEQ ID. NO. 37 in WO2015157252 |
| CD19 CAR | 7429 | SEQ ID. NO. 38 in WO2015157252 |
| CD19 CAR | 7430 | SEQ ID. NO. 39 in WO2015157252 |

TABLE 16-continued

CAR sequences

| Description | SEQ ID NO | Source |
| --- | --- | --- |
| CD19 CAR | 7431 | SEQ ID. NO. 40 in WO2015157252 |
| CD19 CAR | 7432 | SEQ ID. NO. 41 in WO2015157252 |
| CD19 CAR | 7433 | SEQ ID. NO. 42 in WO2015157252 |
| CD19 CAR | 7434 | SEQ ID. NO. 58 in WO2015157252 |
| CD19 CAR | 7435 | SEQ ID NO. 31 in WO2014153270 |
| CD19 CAR | 7436 | SEQ ID NO. 32 in WO2014153270 |
| CD19 CAR | 7437 | SEQ ID NO. 33 in WO2014153270 |
| CD19 CAR | 7438 | SEQ ID NO. 34 in WO2014153270 |
| CD19 CAR | 7439 | SEQ ID NO. 35 in WO2014153270 |
| CD19 CAR | 7440 | SEQ ID NO. 36 in WO2014153270 |
| CD19 CAR | 7441 | SEQ ID NO. 37 in WO2014153270 |
| CD19 CAR | 7442 | SEQ ID NO. 38 in WO2014153270 |
| CD19 CAR | 7443 | SEQ ID NO. 39 in WO2014153270 |
| CD19 CAR | 7444 | SEQ ID NO. 40 in WO2014153270 |
| CD19 CAR | 7445 | SEQ ID NO. 41 in WO2014153270 |
| CD19 CAR | 7446 | SEQ ID NO. 42 in WO2014153270 |
| CD19 CAR | 7447 | in WO2016134284 (no SEQ ID NO) |
| CD19 CAR (Third generation) | 7448 | SEQ ID NO. 13 in WO2016139487 |
| CD19 or CD33 CAR (a CAR OR gate which recognizes CD19 OR CD33) | 7449 | SEQ ID NO. 1 in WO2015075468 |
| CD19CD20 CAR Bispecific CAR | 7450 | SEQ ID NO: 1308 in WO2016164731A2 |
| CD19CD20 CAR Bispecific CAR | 7451 | SEQ ID NO: 2 in U.S. Pat. No. 9,447,194B2 |
| CD19CD20 CAR Bispecific CAR | 7452 | SEQ ID NO: 8 in U.S. Pat. No. 9,447,194B2 |
| CD19CD20 CAR Bispecific CAR | 7453 | SEQ ID NO: 11 in U.S. Pat. No. 9,447,194B2 |
| CD2 CAR | 7454 | SEQ ID NO. 10 in WO2016138491 |
| CD2 CAR | 7455 | SEQ ID NO. 11 in WO2016138491 |
| CD20 CAR | 7456 | SEQ ID NO: 25 in WO2015157399A9 |
| CD20 NCAR | 7457 | SEQ ID NO: 177 in WO2016097231 |
| CD20 NCAR | 7458 | SEQ ID NO: 181 in WO2016097231 |
| CD20 NCAR | 7459 | SEQ ID NO: 182 in WO2016097231 |
| CD20 NCAR | 7460 | SEQ ID NO: 183 in WO2016097231 |
| CD20 NCAR | 7461 | SEQ ID NO: 184 in WO2016097231 |
| CD20 NCAR | 7462 | SEQ ID NO: 185 in WO2016097231 |
| CD20 NCAR | 7463 | SEQ ID NO: 186 in WO2016097231 |
| CD20 NCAR | 7464 | SEQ ID NO: 187 in WO2016097231 |
| CD20 NCAR | 7465 | SEQ ID NO: 205 in WO2016097231 |
| CD20 NCAR | 7466 | SEQ ID NO: 206 in WO2016097231 |
| CD20 NCAR | 7467 | SEQ ID NO: 207 in WO2016097231 |
| CD20 NCAR | 7468 | SEQ ID NO: 208 in WO2016097231 |
| CD20 NCAR | 7469 | SEQ ID NO: 209 in WO2016097231 |
| CD20 NCAR | 7470 | SEQ ID NO: 210 in WO2016097231 |
| CD20 NCAR | 7471 | SEQ ID NO: 211 in WO2016097231 |
| CD20 NCAR | 7472 | SEQ ID NO: 188 in WO2016097231 |
| CD20 NCAR | 7473 | SEQ ID NO: 189 in WO2016097231 |
| CD20 NCAR | 7474 | SEQ ID NO: 190 in WO2016097231 |
| CD20 NCAR | 7475 | SEQ ID NO: 191 in WO2016097231 |
| CD20 NCAR | 7476 | SEQ ID NO: 192 in WO2016097231 |
| CD20 NCAR | 7477 | SEQ ID NO: 193 in WO2016097231 |
| CD20 NCAR | 7478 | SEQ ID NO: 176 in WO2016097231 |
| CD20 NCAR | 7479 | SEQ ID NO: 212 in WO2016097231 |
| CD20 NCAR | 7480 | SEQ ID NO: 194 in WO2016097231 |
| CD20 NCAR | 7481 | SEQ ID NO: 195 in WO2016097231 |
| CD20 NCAR | 7482 | SEQ ID NO: 196 in WO2016097231 |
| CD20 NCAR | 7483 | SEQ ID NO: 197 in WO2016097231 |
| CD20 NCAR | 7484 | SEQ ID NO: 198 in WO2016097231 |
| CD20 NCAR | 7485 | SEQ ID NO: 199 in WO2016097231 |
| CD20 NCAR | 7486 | SEQ ID NO: 200 in WO2016097231 |
| CD20 NCAR | 7487 | SEQ ID NO. 201 in WO2016097231 |
| CD20 NCAR | 7488 | SEQ ID NO: 202 in WO2016097231 |
| CD20 NCAR | 7489 | SEQ ID NO: 203 in WO2016097231 |
| CD20 NCAR | 7490 | SEQ ID NO: 178 in WO2016097231 |
| CD20 NCAR | 7491 | SEQ ID NO: 179 in WO2016097231 |
| CD20 NCAR | 7492 | SEQ ID NO: 180 in WO2016097231 |
| CD22 CAR | 7493 | SEQ ID NO: 380 in WO2016164731A2 |
| CD22 CAR | 7494 | SEQ ID NO: 204 in WO2016164731A2 |
| CD22 CAR | 7495 | SEQ ID NO: 260 in WO2016164731A2 |
| CD22 CAR | 7496 | SEQ ID NO. 266 in WO2016164731A2 |
| CD22 CAR | 7497 | SEQ ID NO: 272 in WO2016164731A2 |
| CD22 CAR | 7498 | SEQ ID NO. 278 in WO2016164731A2 |
| CD22 CAR | 7499 | SEQ ID NO: 284 in WO2016164731A2 |
| CD22 CAR | 7500 | SEQ ID NO: 290 in WO2016164731A2 |
| CD22 CAR | 7501 | SEQ ID NO: 296 in WO2016164731A2 |
| CD22 CAR | 7502 | SEQ ID NO: 302 in WO2016164731A2 |
| CD22 CAR | 7503 | SEQ ID NO: 308 in WO2016164731A2 |
| CD22 CAR | 7504 | SEQ ID NO: 314 in WO2016164731A2 |
| CD22 CAR | 7505 | SEQ ID NO: 213 in WO2016164731A2 |

TABLE 16-continued

CAR sequences

| Description | SEQ ID NO | Source |
|---|---|---|
| CD22 CAR | 7506 | SEQ ID NO: 320 in WO2016164731A2 |
| CD22 CAR | 7507 | SEQ ID NO: 326 in WO2016164731A2 |
| CD22 CAR | 7508 | SEQ ID NO: 332 in WO2016164731A2 |
| CD22 CAR | 7509 | SEQ ID NO: 338 in WO2016164731A2 |
| CD22 CAR | 7510 | SEQ ID NO: 347 in WO2016164731A2 |
| CD22 CAR | 7511 | SEQ ID NO: 350 in WO2016164731A2 |
| CD22 CAR | 7512 | SEQ ID NO: 356 in WO2016164731A2 |
| CD22 CAR | 7513 | SEQ ID NO: 362 in WO2016164731A2 |
| CD22 CAR | 7514 | SEQ ID NO: 368 in WO2016164731A2 |
| CD22 CAR | 7515 | SEQ ID NO: 374 in WO2016164731A2 |
| CD22 CAR | 7516 | SEQ ID NO: 219 in WO2016164731A2 |
| CD22 CAR | 7517 | SEQ ID NO: 386 in WO2016164731A2 |
| CD22 CAR | 7518 | SEQ ID NO: 392 in WO2016164731A2 |
| CD22 CAR | 7519 | SEQ ID NO: 398 in WO2016164731A2 |
| CD22 CAR | 7520 | SEQ ID NO: 404 in WO2016164731A2 |
| CD22 CAR | 7521 | SEQ ID NO: 410 in WO2016164731A2 |
| CD22 CAR | 7522 | SEQ ID NO: 416 in WO2016164731A2 |
| CD22 CAR | 7523 | SEQ ID NO: 421 in WO2016164731A2 |
| CD22 CAR | 7524 | SEQ ID NO: 427 in WO2016164731A2 |
| CD22 CAR | 7525 | SEQ ID NO: 225 in WO2016164731A2 |
| CD22 CAR | 7526 | SEQ ID NO: 230 in WO2016164731A2 |
| CD22 CAR | 7527 | SEQ ID NO: 1109 in WO2016164731A2 |
| CD22 CAR | 7528 | SEQ ID NO: 236 in WO2016164731A2 |
| CD22 CAR | 7529 | SEQ ID NO: 242 in WO2016164731A2 |
| CD22 CAR | 7530 | SEQ ID NO: 248 in WO2016164731A2 |
| CD22 CAR | 7531 | SEQ ID NO: 254 in WO2016164731A2 |
| CD22 CAR | 7532 | SEQ ID NO. 15 in WO2013059593 |
| CD22 CAR | 7533 | SEQ ID NO. 16 in WO2013059593 |
| CD22 CAR | 7534 | SEQ ID NO. 17 in WO2013059593 |
| CD22 CAR | 7535 | SEQ ID NO. 18 in WO2013059593 |
| CD22 CAR | 7536 | SEQ ID NO. 19 in WO2013059593 |
| CD22 CAR | 7537 | SEQ ID NO. 20 in WO2013059593 |
| CD22 CAR | 7538 | SEQ ID NO. 32 in WO2013059593 |
| CD22 CAR | 7539 | SEQ ID NO. 22 in US20150299317 |
| CD22 CAR | 7540 | SEQ ID NO. 23 in US20150299317 |
| CD22 CAR | 7541 | SEQ ID NO. 24 in US20150299317 |
| CD22CD19 Bispecific CAR | 7542 | SEQ ID NO. 29 in WO2016149578 |
| CD22CD19 Bispecific CAR | 7543 | SEQ ID NO. 30 in WO2016149578 |
| CD22CD19 Bispecific CAR | 7544 | SEQ ID NO: 1304 in WO2016164731A2 |
| CD276 CAR | 7545 | SEQ ID NO. 39 in US20160053017 |
| CD276 CAR | 7546 | SEQ ID NO. 40 in US20160053017 |
| CD276 CAR | 7547 | SEQ ID NO. 41 in US20160053017 |
| CD276 CAR | 7548 | SEQ ID NO. 42 in US20160053017 |
| CD276 CAR | 7549 | SEQ ID NO. 43 in US20160053017 |
| CD276 CAR | 7550 | SEQ ID NO. 44 in US20160053017 |
| CD276 CAR | 7551 | SEQ ID NO. 45 in US20160053017 |
| CD276 CAR | 7552 | SEQ ID NO. 46 in US20160053017 |
| CD276 CAR | 7553 | SEQ ID NO. 47 in US20160053017 |
| CD276 CAR | 7554 | SEQ ID NO. 122 in US20160053017 |
| CD276 CAR | 7555 | SEQ ID NO. 123 in US20160053017 |
| CD276 CAR | 7556 | SEQ ID NO. 124 in US20160053017 |
| CD276 CAR | 7557 | SEQ ID NO. 125 in US20160053017 |
| CD276 CAR | 7558 | SEQ ID NO. 126 in US20160053017 |
| CD276 CAR | 7559 | SEQ ID NO. 127 in US20160053017 |
| CD276 CAR | 7560 | SEQ ID NO. 128 in US20160053017 |
| CD276 CAR | 7561 | SEQ ID NO. 129 in US20160053017 |
| CD276 CAR | 7562 | SEQ ID NO. 130 in US20160053017 |
| CD3 CAR | 7563 | SEQ ID NO. 12 in WO2016138491 |
| CD30 CAR | 7564 | SEQ ID NO. 20 in WO2016008973A1 |
| CD30 CAR | 7565 | SEQ ID NO 1 in WO2016116035A1 |
| CD30 CAR | 7566 | in WO2016134284 (no SEQ ID NO) |
| CD30 CAR | 7567 | SEQ ID NO. 2 in WO2016008973A1 |
| CD33 CAR | 7568 | SEQ ID NO. 48 in WO2016014576 |
| CD33 CAR | 7569 | SEQ ID NO. 49 in WO2016014576 |
| CD33 CAR | 7570 | SEQ ID NO. 50 in WO2016014576 |
| CD33 CAR | 7571 | SEQ ID NO. 51 in WO2016014576 |
| CD33 CAR | 7572 | SEQ ID NO. 52 in WO2016014576 |
| CD33 CAR | 7573 | SEQ ID NO. 53 in WO2016014576 |
| CD33 CAR | 7574 | SEQ ID NO. 54 in WO2016014576 |
| CD33 CAR | 7575 | SEQ ID NO. 55 in WO2016014576 |
| CD33 CAR | 7576 | SEQ ID NO. 83 in WO2016014576 |
| CD33 CAR | 7577 | SEQ ID NO. 19 in WO2015150526A2 |
| CD33 CAR | 7578 | SEQ ID NO. 20 in WO2015150526A2 |
| CD33 CAR | 7579 | SEQ ID NO. 21 in WO2015150526A2 |
| CD33 CAR | 7580 | SEQ ID NO. 22 in WO2015150526A2 |
| CD33 CAR | 7581 | SEQ ID NO. 23 in WO2015150526A2 |

TABLE 16-continued

CAR sequences

| Description | SEQ ID NO | Source |
|---|---|---|
| CD33 CAR | 7582 | SEQ ID NO. 24 in WO2015150526A2 |
| CD33 CAR | 7583 | SEQ ID NO. 25 in WO2015150526A2 |
| CD33 CAR | 7584 | SEQ ID NO. 26 in WO2015150526A2 |
| CD33 CAR | 7585 | SEQ ID NO. 27 in WO2015150526A2 |
| CD33 CAR | 7586 | SEQ ID NO. 28 in WO2015150526A2 |
| CD33 CAR | 7587 | SEQ ID NO. 29 in WO2015150526A2 |
| CD33 CAR | 7588 | SEQ ID NO. 30 in WO2015150526A2 |
| CD33 CAR | 7589 | SEQ ID NO. 31 in WO2015150526A2 |
| CD33 CAR | 7590 | SEQ ID NO. 32 in WO2015150526A2 |
| CD33 CAR | 7591 | SEQ ID NO. 33 in WO2015150526A2 |
| CD33 CAR | 7592 | SEQ ID NO. 34 in WO2015150526A2 |
| CD33 CAR | 7593 | SEQ ID NO. 35 in WO2015150526A2 |
| CD33 CAR | 7594 | SEQ ID NO. 36 in WO2015150526A2 |
| CD33 CAR | 7595 | SEQ ID NO. 37 in WO2015150526A2 |
| CD33 CAR | 7596 | SEQ ID NO. 38 in WO2015150526A2 |
| CD33 CAR | 7597 | SEQ ID NO. 39 in WO2015150526A2 |
| CD33 CAR | 7598 | SEQ ID NO. 40 in WO2015150526A2 |
| CD33 CAR | 7599 | SEQ ID NO. 41 in WO2015150526A2 |
| CD33 CAR | 7600 | SEQ ID NO. 42 in WO2015150526A2 |
| CD33 CAR | 7601 | SEQ ID NO. 48 in WO2015150526A2 |
| CD33 CAR | 7602 | SEQ ID NO. 49 in WO2015150526A2 |
| CD33 CAR | 7603 | SEQ ID NO. 50 in WO2015150526A2 |
| CD33 CAR | 7604 | SEQ ID NO. 51 in WO2015150526A2 |
| CD33 CAR | 7605 | SEQ ID NO. 52 in WO2015150526A2 |
| CD33 CAR | 7606 | SEQ ID NO. 53 in WO2015150526A2 |
| CD33 CAR | 7607 | SEQ ID NO. 54 in WO2015150526A2 |
| CD33 CAR | 7608 | SEQ ID NO. 55 in WO2015150526A2 |
| CD33 CAR | 7609 | SEQ ID NO. 56 in WO2015150526A2 |
| CD33 CAR | 7610 | SEQ ID NO. 57 in WO2015150526A2 |
| CD33 CAR | 7611 | SEQ ID NO. 58 in WO2015150526A2 |
| CD33 CAR | 7612 | SEQ ID NO. 59 in WO2015150526A2 |
| CD33 CAR | 7613 | SEQ ID NO. 60 in WO2015150526A2 |
| CD33 CAR | 7614 | SEQ ID NO. 61 in WO2015150526A2 |
| CD33 CAR | 7615 | SEQ ID NO. 62 in WO2015150526A2 |
| CD33 CAR | 7616 | SEQ ID NO. 63 in WO2015150526A2 |
| CD33 CAR | 7617 | SEQ ID NO. 64 in WO2015150526A2 |
| CD33 CAR | 7618 | SEQ ID NO. 65 in WO2015150526A2 |
| CD33 CAR | 7619 | SEQ ID NO. 66 in WO2015150526A2 |
| CD33 CAR | 7620 | SEQ ID NO. 67 in WO2015150526A2 |
| CD33 CAR | 7621 | SEQ ID NO. 68 in WO2015150526A2 |
| CD33 CAR | 7622 | SEQ ID NO. 69 in WO2015150526A2 |
| CD33 CAR | 7623 | SEQ ID NO. 70 in WO2015150526A2 |
| CD33 CAR | 7624 | SEQ ID NO. 71 in WO2015150526A2 |
| CD38 CAR | 7625 | SEQ ID NO: 70 in WO2016097231 |
| CD38 CAR | 7626 | SEQ ID NO: 71 in WO2016097231 |
| CD38 CAR | 7627 | SEQ ID NO: 72 in WO2016097231 |
| CD38 CAR | 7628 | SEQ ID NO: 64 in WO2016097231 |
| CD38 CAR | 7629 | SEQ ID NO: 65 in WO2016097231 |
| CD38 CAR | 7630 | SEQ ID NO: 66 in WO2016097231 |
| CD38 CAR | 7631 | SEQ ID NO: 67 in WO2016097231 |
| CD38 CAR | 7632 | SEQ ID NO: 68 in WO2016097231 |
| CD38 CAR | 7633 | SEQ ID NO: 69 in WO2016097231 |
| CD38 CAR | 7634 | SEQ ID No. 35 in WO2015121454 |
| CD38 CAR | 7635 | SEQ ID No. 36 in WO2015121454 |
| CD38 CAR | 7636 | SEQ ID No. 37 in WO2015121454 |
| CD4 CAR | 7637 | SEQ ID NO. 13 in WO2016138491 |
| CD4 CAR | 7638 | SEQ ID NO. 14 in WO2016138491 |
| CD410 CAR | 7639 | SEQ ID NO: 7 in EP3074419A2 |
| CD435 CAR | 7640 | SEQ ID NO: 5 in EP3074419A2 |
| CD44 CAR | 7641 | SEQ ID NO. 21 in WO2016042461A1 |
| CD44 CAR | 7642 | SEQ ID NO. 22 in WO2016042461A1 |
| CD44 CAR | 7643 | SEQ ID NO. 23 in WO2016042461A1 |
| CD44 CAR | 7644 | SEQ ID NO. 24 in WO2016042461A1 |
| CD44 CAR | 7645 | SEQ ID NO. 25 in WO2016042461A1 |
| CD44 CAR | 7646 | SEQ ID NO. 26 in WO2016042461A1 |
| CD44 CAR | 7647 | SEQ ID NO. 27 in WO2016042461A1 |
| CD44 CAR | 7648 | SEQ ID NO. 28 in WO2016042461A1 |
| CD44 CAR | 7649 | SEQ ID NO. 31 in WO2016042461A1 |
| CD44 CAR | 7650 | SEQ ID NO. 32 in WO2016042461A1 |
| CD44 CAR | 7651 | SEQ ID NO. 33 in WO2016042461A1 |
| CD44 CAR | 7652 | SEQ ID NO. 34 in WO2016042461A1 |
| CD44 CAR | 7653 | SEQ ID NO. 35 in WO2016042461A1 |
| CD4-DDY3 CAR | 7654 | SEQ ID NO: 9 in EP3074419A2 |
| CD5 CAR | 7655 | SEQ ID NO. 15 in WO2016138491 |
| CD5 CAR | 7656 | SEQ ID NO: 13 in WO2016172606A1 |
| CD52 CAR | 7657 | SEQ ID NO. 18 in WO2016138491 |

TABLE 16-continued

CAR sequences

| Description | SEQ ID NO | Source |
|---|---|---|
| CD7 CAR | 7658 | SEQ ID NO. 17 in WO2016138491 |
| CD70 CAR | 7659 | SEQ ID NO. 100 in WO2015121454 |
| CD70 CAR | 7660 | SEQ ID NO. 93 in WO2015121454 |
| CD70 CAR | 7661 | SEQ ID NO. 94 in WO2015121454 |
| CD70 CAR | 7662 | SEQ ID NO. 96 in WO2015121454 |
| CD70 CAR | 7663 | SEQ ID NO. 101 in WO2015121454 |
| CD70 CAR | 7664 | SEQ ID NO. 95 in WO2015121454 |
| CD70 CAR | 7665 | SEQ ID NO. 97 in WO2015121454 |
| CD70 CAR | 7666 | SEQ ID NO. 98 in WO2015121454 |
| CD8 stalk APRIL CAR | 7667 | SEQ ID NO: 51 in US20160296562A1 |
| CEA CAR | 7668 | SEQ ID NO. 4 in WO2016008973A1 |
| CEA CAR | 7669 | SEQ ID NO. 29 in US20140242701A |
| CEA CAR | 7670 | SEQ ID NO. 30 in US20140242701A |
| Chimeric VNARCAR 1 | 7671 | SEQ ID NO: 105 in US20160333094A1 |
| Chimeric VNARCAR 2 | 7672 | SEQ ID NO: 106 in US20160333094A1 |
| Chimeric VNARCAR 3 | 7673 | SEQ ID NO: 107 in US20160333094A1 |
| Chimeric VNARCAR 4 | 7674 | SEQ ID NO: 108 in US20160333094A1 |
| Chimeric VNARCAR 5 | 7675 | SEQ ID NO: 109 in US20160333094A1 |
| Chimeric VNARCAR 6 | 7676 | SEQ ID NO: 110 in US20160333094A1 |
| CLDN6 CAR | 7677 | SEQ ID NO. 22 in WO2016150400 |
| CLDN6 CAR | 7678 | SEQ ID NO. 23 in WO2016150400 |
| CLDN6 CAR | 7679 | SEQ ID NO. 24 in WO2016150400 |
| CLL1 CAR | 7680 | SEQ ID NO: 148 in WO2016179319A1 |
| CLL1 CAR | 7681 | SEQ ID NO. 35 in WO2016120218 |
| CLL1 CAR | 7682 | SEQ ID NO. 36 in WO2016120218 |
| CLL1 CAR | 7683 | SEQ ID NO. 37 in WO2016120218 |
| CLL1 CAR | 7684 | SEQ ID NO. 38 in WO2016120218 |
| CLL1 CAR | 7685 | SEQ ID NO. 39 in WO2016120218 |
| CLL1 CAR | 7686 | SEQ ID NO. 40 in WO2016120218 |
| CLL1 CAR | 7687 | SEQ ID NO. 41 in WO2016120218 |
| CLL1 CAR | 7688 | SEQ ID NO. 42 in WO2016120218 |
| CLL1 CAR | 7689 | SEQ ID NO. 43 in WO2016120218 |
| CLL1 CAR | 7690 | SEQ ID NO. 44 in WO2016120218 |
| CLL1 CAR | 7691 | SEQ ID NO. 45 in WO2016120218 |
| CLL1 CAR | 7692 | SEQ ID NO. 46 in WO2016120218 |
| CLL1 CAR | 7693 | SEQ ID NO. 47 in WO2016120218 |
| CLL1 CAR | 7694 | SEQ ID NO. 48 in WO2016120218 |
| CLL1 CAR | 7695 | SEQ ID NO. 49 in WO2016120218 |
| CLL1 CAR | 7696 | SEQ ID NO. 50 in WO2016120218 |
| CLL1 CAR | 7697 | SEQ ID NO. 51 in WO2016120218 |
| CLL1 CAR | 7698 | SEQ ID NO. 52 in WO2016120218 |
| CLL1 CAR | 7699 | SEQ ID NO. 53 in WO2016120218 |
| CLL1 CAR | 7700 | SEQ ID NO. 54 in WO2016120218 |
| CLL1 CAR | 7701 | SEQ ID NO. 55 in WO2016120218 |
| CLL1 CAR | 7702 | SEQ ID NO. 56 in WO2016120218 |
| CLL1 CAR | 7703 | SEQ ID NO. 57 in WO2016120218 |
| CLL1 CAR | 7704 | SEQ ID NO. 58 in WO2016120218 |
| CLL1 CAR | 7705 | SEQ ID NO. 59 in WO2016120218 |
| CLL1 CAR | 7706 | SEQ ID NO. 60 in WO2016120218 |
| CLL1 CAR | 7707 | SEQ ID NO. 61 in WO2016120218 |
| CLL1 CAR | 7708 | SEQ ID NO. 62 in WO2016120218 |
| CLL1 CAR | 7709 | SEQ ID NO. 63 in WO2016120218 |
| CLL1 CAR | 7710 | SEQ ID NO. 64 in WO2016120218 |
| CLL1 CAR | 7711 | SEQ ID NO. 65 in WO2016120218 |
| CLL1 CAR | 7712 | SEQ ID NO. 66 in WO2016120218 |
| CLL1 CAR | 7713 | SEQ ID NO. 67 in WO2016120218 |
| CLL1 CAR | 7714 | SEQ ID NO. 68 in WO2016120218 |
| CLL1 CAR | 7715 | SEQ ID NO. 69 in WO2016120218 |
| CLL1 CAR | 7716 | SEQ ID NO. 70 in WO2016120218 |
| CLL1 CAR | 7717 | SEQ ID NO. 71 in WO2016120218 |
| CLL1 CAR | 7718 | SEQ ID NO. 72 in WO2016120218 |
| CLL1 CAR | 7719 | SEQ ID NO. 73 in WO2016120218 |
| CLL1 CAR | 7720 | SEQ ID NO. 74 in WO2016120218 |
| CLL1 CAR | 7721 | SEQ ID NO. 75 in WO2016120218 |
| CLL1 CAR | 7722 | SEQ ID NO. 76 in WO2016120218 |
| CLL1 CAR | 7723 | SEQ ID NO. 77 in WO2016120218 |
| CLL1 CAR | 7724 | SEQ ID NO. 78 in WO2016120218 |
| CLL1 CAR | 7725 | SEQ ID NO. 79 in WO2016120218 |
| CLL1 CAR | 7726 | SEQ ID NO. 80 in WO2016120218 |
| CLL1 CAR | 7727 | SEQ ID NO. 81 in WO2016120218 |
| CLL1 CAR | 7728 | SEQ ID NO. 82 in WO2016120218 |
| CLL1 CAR | 7729 | SEQ ID NO. 83 in WO2016120218 |
| CLL1 CAR | 7730 | SEQ ID NO. 84 in WO2016120218 |
| CLL1 CAR | 7731 | SEQ ID NO. 85 in WO2016120218 |
| CLL1 CAR | 7732 | SEQ ID NO. 86 in WO2016120218 |
| CLL1 CAR | 7733 | SEQ ID NO. 87 in WO2016120218 |

TABLE 16-continued

CAR sequences

| Description | SEQ ID NO | Source |
|---|---|---|
| CLL1 CAR | 7734 | SEQ ID NO. 88 in WO2016120218 |
| CLL1 CAR | 7735 | SEQ ID NO. 89 in WO2016120218 |
| CLL1 CAR | 7736 | SEQ ID NO. 90 in WO2016120218 |
| CLL1 CAR | 7737 | SEQ ID NO. 91 in WO2016120218 |
| CLL1 CAR | 7738 | SEQ ID NO. 92 in WO2016120218 |
| CLL1 CAR | 7739 | SEQ ID NO. 93 in WO2016120218 |
| CLL1 CAR | 7740 | SEQ ID NO. 94 in WO2016120218 |
| CLL1 CAR | 7741 | SEQ ID NO. 95 in WO2016120218 |
| CLL1 CAR | 7742 | SEQ ID NO. 96 in WO2016120218 |
| CLL1 CAR | 7743 | SEQ ID NO. 97 in WO2016120218 |
| CLL1 CAR | 7744 | SEQ ID NO. 98 in WO2016120218 |
| CLL1 CAR | 7745 | SEQ ID NO. 99 in WO2016120218 |
| CLL1 CAR | 7746 | SEQ ID NO. 100 in WO2016120218 |
| CLL1 CAR | 7747 | SEQ ID NO. 101 in WO2016120218 |
| CLL1 CAR | 7748 | SEQ ID NO. 102 in WO2016120218 |
| CLL1 CAR | 7749 | SEQ ID NO. 103 in WO2016120218 |
| CLL1 CAR | 7750 | SEQ ID NO. 104 in WO2016120218 |
| CLL1 CAR | 7751 | SEQ ID NO. 105 in WO2016120218 |
| CLL1 CAR | 7752 | SEQ ID NO. 106 in WO2016120218 |
| CLL1 CAR | 7753 | SEQ ID NO. 107 in WO2016120218 |
| CLL1 CAR | 7754 | SEQ ID NO. 108 in WO2016120218 |
| CLL1 CAR | 7755 | SEQ ID NO. 109 in WO2016120218 |
| CLL1 CAR | 7756 | SEQ ID NO. 110 in WO2016120218 |
| CLL1 CAR | 7757 | SEQ ID NO. 111 in WO2016120218 |
| CLL1 CAR | 7758 | SEQ ID NO. 112 in WO2016120218 |
| CLL1 CAR | 7759 | SEQ ID NO. 91 in WO2016014535 |
| CLL1 CAR | 7760 | SEQ ID NO. 92 in WO2016014535 |
| CLL1 CAR | 7761 | SEQ ID NO. 93 in WO2016014535 |
| CLL1 CAR | 7762 | SEQ ID NO. 94 in WO2016014535 |
| CLL1 CAR | 7763 | SEQ ID NO. 95 in WO2016014535 |
| CLL1 CAR | 7764 | SEQ ID NO. 96 in WO2016014535 |
| CLL1 CAR | 7765 | SEQ ID NO. 97 in WO2016014535 |
| CLL1 CAR | 7766 | SEQ ID NO. 98 in WO2016014535 |
| CLL1 CAR | 7767 | SEQ ID NO. 99 in WO2016014535 |
| CLL1 CAR | 7768 | SEQ ID NO. 100 in WO2016014535 |
| CLL1 CAR | 7769 | SEQ ID NO. 101 in WO2016014535 |
| CLL1 CAR | 7770 | SEQ ID NO. 102 in WO2016014535 |
| CLL1 CAR | 7771 | SEQ ID NO. 103 in WO2016014535 |
| CLL1 CAR | 7772 | SEQ ID NO. 197 in WO2016014535 |
| COM22 CAR | 7773 | SEQ ID NO: 358 in US20160297884A1 |
| COM22 CAR | 7774 | SEQ ID NO: 359 in US20160297884A1 |
| COM22 CAR | 7775 | SEQ ID NO: 360 in US20160297884A1 |
| CS1 CAR | 7776 | SEQ ID No. 55 in WO2015121454 |
| CS1 CAR | 7777 | SEQ ID No. 57 in WO2015121454 |
| CS1 CAR | 7778 | SEQ ID No. 60 in WO2015121454 |
| CS1 CAR | 7779 | SEQ ID No. 54 in WO2015121454 |
| CS1 CAR | 7780 | SEQ ID No. 56 in WO2015121454 |
| CS1 CAR | 7781 | SEQ ID No. 48 in WO2015121454 |
| CS1 CAR | 7782 | SEQ ID No. 49 in WO2015121454 |
| CS1 CAR | 7783 | SEQ ID No. 50 in WO2015121454 |
| CS1 CAR | 7784 | SEQ ID No. 51 in WO2015121454 |
| CS1 CAR | 7785 | SEQ ID No. 52 in WO2015121454 |
| CS1 CAR | 7786 | SEQ ID No. 53 in WO2015121454 |
| CS1 CAR | 7787 | SEQ ID No. 58 in WO2015121454 |
| CS1 CAR | 7788 | SEQ ID No. 59 in WO2015121454 |
| CS1 CAR | 7789 | SEQ ID No. 61 in WO2015121454 |
| CS1 CAR | 7790 | SEQ ID No. 62 in WO2015121454 |
| CS1 CAR | 7791 | SEQ ID NO. 28 in WO2014179759A1 |
| DDD1/AD1 based zip CAR | 7792 | SEQ ID NO. 36 in WO2016124930 |
| DDD1/AD1 Zip CAR | 7793 | SEQ ID NO. 37 in WO2016124930 |
| EGFR CAR | 7794 | SEQ ID NO. 3 in WO2014130657 |
| EGFR CAR | 7795 | SEQ ID NO. 2 in WO2014130657 |
| EGFR CAR | 7796 | SEQ ID NO. 36 in US20140242701A |
| EGFR CAR | 7797 | SEQ ID NO. 37 in US20140242701A |
| EGFR CAR | 7798 | SEQ ID NO. 38 in US20140242701A |
| EGFR CAR | 7799 | SEQ ID NO. 39 in US20140242701A |
| EGFR CAR | 7800 | SEQ ID NO. 35 in US20140242701A |
| EGFR CAR | 7801 | SEQ ID NO. 43 in WO2014130657 |
| EGFR CAR | 7802 | SEQ ID NO. 96 in WO2014130657 |
| EGFR CAR | 7803 | SEQ ID NO. 49 in WO2014130657 |
| EGFR CAR | 7804 | SEQ ID NO. 55 in WO2014130657 |
| EGFR CAR | 7805 | SEQ ID NO. 61 in WO2014130657 |
| EGFR CAR | 7806 | SEQ ID NO. 67 in WO2014130657 |
| EGFR CAR | 7807 | SEQ ID NO. 73 in WO2014130657 |
| EGFR CAR | 7808 | SEQ ID NO. 79 in WO2014130657 |
| EGFR CAR | 7809 | SEQ ID NO. 85 in WO2014130657 |

TABLE 16-continued

CAR sequences

| Description | SEQ ID NO | Source |
|---|---|---|
| EGFR CAR | 7810 | SEQ ID NO. 90 in WO2014130657 |
| EGFR CAR | 7811 | SEQ ID NO. 1 in WO2014130657 |
| EGFR vIII CAR | 7812 | SEQ ID NO. 15 in WO2016016341 |
| EGFR vIII CAR | 7813 | SEQ ID NO. 16 in WO2016016341 |
| EGFR vIII CAR | 7814 | SEQ ID NO. 17 in WO2016016341 |
| EGFR vIII CAR | 7815 | SEQ ID NO. 18 in WO2016016341 |
| EGFR vIII CAR | 7816 | SEQ ID NO. 24 in WO2016016341 |
| EGFR vIII CAR | 7817 | SEQ ID NO. 25 in WO2016016341 |
| EGFR vIII CAR | 7818 | SEQ ID NO. 26 in WO2016016341 |
| EGFR vIII CAR | 7819 | SEQ ID NO. 27 in WO2016016341 |
| EGFR vIII CAR | 7820 | SEQ ID NO: 5 in US20160311907A1 |
| EGFR vIII CAR | 7821 | SEQ ID NO: 10 in US20160311907A1 |
| EGFR vIII CAR | 7822 | SEQ ID NO: 12 in US20160311907A1 |
| EGFR vIII CAR | 7823 | SEQ ID NO: 8 in US20160311907A1 |
| EGFR vIII CAR | 7824 | SEQ ID NO: 31 in US20160311907A1 |
| EGFR vIII CAR | 7825 | SEQ ID NO: 30 in US20160311907A1 |
| EGFR vIII CAR | 7826 | SEQ ID NO: 3 in US20160311907A1 |
| EGFR vIII CAR | 7827 | SEQ ID NO: 10 in US20160200819A1 |
| EGFRvIII CAR | 7828 | SEQ ID NO: 43 in U.S. Pat. No. 9,394,368B2 |
| EGFRvIII CAR | 7829 | SEQ ID NO: 49 in U.S. Pat. No. 9,394,368B2 |
| EGFRvIII CAR | 7830 | SEQ ID NO: 55 in U.S. Pat. No. 9,394,368B2 |
| EGFRvIII CAR | 7831 | SEQ ID NO: 61 in U.S. Pat. No. 9,394,368B2 |
| EGFRvIII CAR | 7832 | SEQ ID NO: 67 in U.S. Pat. No. 9,394,368B2 |
| EGFRvIII CAR | 7833 | SEQ ID NO: 73 in U.S. Pat. No. 9,394,368B2 |
| EGFRvIII CAR | 7834 | SEQ ID NO: 79 in U.S. Pat. No. 9,394,368B2 |
| EGFRvIII CAR | 7835 | SEQ ID NO: 85 in U.S. Pat. No. 9,394,368B2 |
| EGFRvIII CAR | 7836 | SEQ ID NO: 90 in U.S. Pat. No. 9,394,368B2 |
| EGFRvIII CAR | 7837 | SEQ ID NO: 96 in U.S. Pat. No. 9,394,368B2 |
| EGFRvIII CAR | 7838 | SEQ ID NO. 49 in US20170008963A1 |
| EGFRvIII CAR | 7839 | SEQ ID NO. 55 in US20170008963A1 |
| EGFRvIII CAR | 7840 | SEQ ID NO. 61 in US20170008963A1 |
| EGFRvIII CAR | 7841 | SEQ ID NO. 67 in US20170008963A1 |
| EGFRvIII CAR | 7842 | SEQ ID NO. 73 in US20170008963A1 |
| EGFRvIII CAR | 7843 | SEQ ID NO. 79 in US20170008963A1 |
| EGFRvIII CAR | 7844 | SEQ ID NO. 85 in US20170008963A1 |
| EGFRvIII CAR | 7845 | SEQ ID NO. 90 in US20170008963A1 |
| EGFRvIII CAR | 7846 | SEQ ID NO. 10 in US20140037628 |
| EGFRvIII CAR | 7847 | SEQ ID NO. 11 in US20140037628 |
| EGFRvIII CAR | 7848 | SEQ ID NO. 2 in US20170008963A1 |
| EGFRvIII CAR | 7849 | |
| "EGFRvIII scFv | 7850 | SEQ ID NO. 1 in US20170008963A1 |
| EGFRvIII scFv | 7851 | |
| FcRL5 CAR | 7852 | SEQ ID NO. 11 in US20170008963A1 |
| Folate Receptor CAR | 7853 | |
| Folate Receptor CAR | 7854 | SEQ ID NO. 12 in US20170008963A1 |
| Fra CAR | 7855 | SEQ ID NO: 959 (WO2016090337) |
| Fra CAR | 7856 | SEQ ID NO. 13 in US20170002072A1 |
| FRβ CAR | 7857 | SEQ ID NO. 22 in US20170002072A1 |
| FRβ CAR | 7858 | SEQ ID NO: 13 in U.S. Pat. No. 9,402,865B2 |
| FRβ CAR | 7859 | SEQ ID NO: 22 in U.S. Pat. No. 9,402,865B2 |
| FRβ CAR | 7860 | SEQ ID NO: 2 in U.S. Pat. No. 9,446,105B2 |
| FRβ CAR | 7861 | SEQ ID NO: 4 in U.S. Pat. No. 9,446,105B2 |
| FRβ CAR | 7862 | SEQ ID NO: 6 in U.S. Pat. No. 9,446,105B2 |
| GCN4 CAR | 7863 | SEQ ID NO: 8 in U.S. Pat. No. 9,446,105B2 |
| GCN4 CAR | 7864 | SEQ ID NO: 10 in U.S. Pat. No. 9,446,105B2 |
| GD2 CAR | 7865 | SEQ ID NO: 12 in U.S. Pat. No. 9,446,105B2 |
| GD2 CAR | 7866 | SEQ ID NO: 273 in WO2016168773A3 |
| GD2 CAR | 7867 | SEQ ID NO: 274 in WO2016168773A3 |
| GD2 CAR | 7868 | SEQ ID No. 26 in WO2015132604 |
| GD2 CAR | 7869 | SEQ ID No. 27 in WO2015132604 |
| GD2 CAR | 7870 | SEQ ID No. 28 in WO2015132604 |
| GD2 CAR | 7871 | SEQ ID No. 29 in WO2015132604 |
| GD2 CAR | 7872 | SEQ ID No. 30 in WO2015132604 |
| GD2 CAR | 7873 | SEQ ID No. 31 in WO2015132604 |
| GD2 CAR | 7874 | SEQ ID No. 32 in WO2015132604 |
| GD2 CAR | 7875 | SEQ ID No. 33 in WO2015132604 |
| GD2 CAR | 7876 | SEQ ID No. 34 in WO2015132604 |
| GD2 CAR | 7877 | SEQ ID No. 35 in WO2015132604 |
| GD2 CAR | 7878 | SEQ ID No. 36 in WO2015132604 |
| GD2 CAR | 7879 | SEQ ID No. 37 in WO2015132604 |
| GD2 CAR | 7880 | in WO2016134284 (no SEQ ID NO) |
| GD3 CAR | 7881 | in WO2016134284 (no SEQ ID NO) |
| GD3 CAR | 7882 | in WO2016134284 (no SEQ ID NO) |
| GD3 CAR | 7883 | in WO2016134284 (no SEQ ID NO) |
| GD3 CAR | 7884 | SEQ ID NO: 19 in WO2016185035A1 |
| GD3 CAR | 7885 | SEQ ID NO: 20 in WO2016185035A1 |

TABLE 16-continued

CAR sequences

| Description | SEQ ID NO | Source |
|---|---|---|
| GD3 CAR | 7886 | SEQ ID NO: 21 in WO2016185035A1 |
| GD3 CAR | 7887 | SEQ ID NO: 22 in WO2016185035A1 |
| GD3 CAR | 7888 | SEQ ID NO: 23 in WO2016185035A1 |
| GD3 CAR | 7889 | SEQ ID NO: 24 in WO2016185035A1 |
| GD3 CAR | 7890 | SEQ ID NO: 25 in WO2016185035A1 |
| GD3 CAR | 7891 | SEQ ID NO: 26 in WO2016185035A1 |
| GFRalpha CAR | 7892 | SEQ ID NO: 27 in WO2016185035A1 |
| GPC3 CAR | 7893 | SEQ ID NO: 28 in WO2016185035A1 |
| GPC3 CAR | 7894 | SEQ ID NO: 29 in WO2016185035A1 |
| GPC3 CAR | 7895 | |
| GPC3 CAR | 7896 | SEQ ID NO. 3 in WO2016049459 |
| GPC3 CAR | 7897 | SEQ ID NO. 27 in WO2016049459 |
| GPC3 CAR | 7898 | SEQ ID NO. 10 in WO2016049459 |
| GPC3 CAR | 7899 | SEQ ID NO. 29 in WO2016049459 |
| GPC3 CAR | 7900 | SEQ ID NO. 14 in WO2016049459 |
| GPC3 CAR | 7901 | SEQ ID NO. 30 in WO2016049459 |
| GPC3 CAR | 7902 | SEQ ID NO. 31 in WO2016049459 |
| GPC3 CAR | 7903 | SEQ ID NO. 18 in WO2016049459 |
| GPC3 CAR | 7904 | SEQ ID NO. 33 in WO2016049459 |
| GPC3 CAR | 7905 | SEQ ID NO: 22 in US20160215261A1 |
| Her1/Her3 CAR Bispecific | 7906 | SEQ ID NO: 23 in US20160215261A1 |
| Her1/Her3 CAR Bispecific | 7907 | SEQ ID NO: 24 in US20160215261A1 |
| HER2 CAR | 7908 | SEQ ID NO: 25 in US20160215261A1 |
| HER2 CAR | 7909 | SEQ ID NO: 9 of WO2016073629 |
| HER2 CAR | 7910 | SEQ ID NO: 10 of WO2016073629 |
| HER2 CAR | 7911 | SEQ ID NO: 17 in US20160333114A1 |
| HER2 CAR | 7912 | SEQ ID NO: 28 in US20160333114A1 |
| HER2 CAR | 7913 | SEQ ID NO: 98 in US20160333114A1 |
| HER2 CAR | 7914 | SEQ ID NO: 110 in US20160333114A1 |
| HER2 CAR | 7915 | SEQ ID NO: 271 in WO2016168773A3 |
| HER2 CAR | 7916 | SEQ ID NO: 272 in WO2016168773A3 |
| HER2 CAR | 7917 | SEQ ID NO: 5 in WO2016168769A1 |
| HERVK CAR | 7918 | SEQ ID NO: 6 in WO2016168769A1 |
| HIV Env CAR | 7919 | SEQ ID NO: 48 in WO2016168766A1 |
| HIV Env CAR | 7920 | SEQ ID NO: 49 in WO2016168766A1 |
| HIV Env CAR | 7921 | SEQ ID NO: 4 in EP2997134A4 |
| HIV Env CAR | 7922 | SEQ ID NO. 7 in WO2015077789 |
| HIV Env CAR | 7923 | SEQ ID NO. 9 in WO2015077789 |
| HIV Env CAR | 7924 | SEQ ID NO. 47 in WO2015077789 |
| HIV Env CAR | 7925 | SEQ ID NO. 49 in WO2015077789 |
| HSP70 CAR | 7926 | SEQ ID NO. 51 in WO2015077789 |
| HSP70 CAR | 7927 | SEQ ID NO. 53 in WO2015077789 |
| HSP70 CAR | 7928 | SEQ ID NO. 5 in WO2015077789 |
| HSP70 CAR | 7929 | SEQ ID NO. 21 in WO2016120217 |
| HSP70 CAR | 7930 | SEQ ID NO. 22 in WO2016120217 |
| HSP70 CAR | 7931 | SEQ ID NO. 23 in WO2016120217 |
| HSP70CAR | 7932 | SEQ ID NO. 24 in WO2016120217 |
| HSP70 CAR | 7933 | SEQ ID NO. 25 in WO2016120217 |
| HSP70 CAR | 7934 | SEQ ID NO. 26 in WO2016120217 |
| HSP70 CAR | 7935 | SEQ ID NO. 27 in WO2016120217 |
| HSP70 CAR | 7936 | SEQ ID NO. 28 in WO2016120217 |
| HSP70 CAR | 7937 | SEQ ID NO. 29 in WO2016120217 |
| IL 13 CAR | 7938 | SEQ ID NO. 30 in WO2016120217 |
| IL 13 CAR | 7939 | SEQ ID NO. 31 in WO2016120217 |
| IL 13 CAR | 7940 | SEQ ID NO. 32 in WO2016120217 |
| IL13Ra2specific CAR | 7941 | SEQ ID NO. 4 in WO2016089916A1 |
| IL13Ra2specific CAR | 7942 | SEQ ID NO. 5 in WO2016089916A1 |
| IL13Ra2specific CAR | 7943 | SEQ ID NO. 6 in WO2016089916A1 |
| IL13Ra2specific CAR | 7944 | SEQ ID NO. 47 in WO2016123143 |
| IL13Ra2specific CAR | 7945 | SEQ ID NO. 49 in WO2016123143 |
| IL13Rα2 CAR | 7946 | SEQ ID NO. 51 in WO2016123143 |
| IL13Rα2 CAR | 7947 | SEQ ID NO. 53 in WO2016123143 |
| IL13Rα2 CAR | 7948 | SEQ ID NO. 55 in WO2016123143 |
| IL13Rα2 CAR | 7949 | SEQ ID NO: 1 in US20160340649A1 |
| IL13Rα2 CAR | 7950 | SEQ ID NO: 31 in US20160340649A1 |
| IL13Rα2 CAR | 7951 | SEQ ID NO: 32 in US20160340649A1 |
| IL13Rα2 CAR | 7952 | SEQ ID NO: 33 in US20160340649A1 |
| IL13Rα2 CAR | 7953 | SEQ ID NO: 34 in US20160340649A1 |
| IL13Rα2 CAR | 7954 | SEQ ID NO: 35 in US20160340649A1 |
| IL13Rα2 CAR | 7955 | SEQ ID NO: 36 in US20160340649A1 |
| IL13Rα2 CAR | 7956 | SEQ ID NO: 37 in US20160340649A1 |
| IL13Rα2 CAR | 7957 | SEQ ID NO: 38 in US20160340649A1 |
| IL13Rα2 CAR | 7958 | SEQ ID NO: 39 in US20160340649A1 |
| IL13Rα2 CAR | 7959 | SEQ ID NO: 40 in US20160340649A1 |
| IL13Rα2 CAR | 7960 | SEQ ID NO: 41 in US20160340649A1 |
| IL13Rα2 CAR | 7961 | SEQ ID NO: 42 in US20160340649A1 |

TABLE 16-continued

CAR sequences

| Description | SEQ ID NO | Source |
|---|---|---|
| IL13Rα2 CAR | 7962 | SEQ ID NO: 43 in US20160340649A1 |
| IL13Rα2 CAR | 7963 | SEQ ID NO: 44 in US20160340649A1 |
| IL13Rα2 CAR | 7964 | SEQ ID NO: 45 in US20160340649A1 |
| KMA CAR | 7965 | SEQ ID NO: 46 in US20160340649A1 |
| MESOTHELIN CAR | 7966 | SEQ ID NO: 47 in US20160340649A1 |
| MESOTHELIN CAR | 7967 | SEQ ID NO: 48 in US20160340649A1 |
| MESOTHELIN CAR | 7968 | SEQ ID NO: 27 in WO2016172703A2 |
| MESOTHELIN CAR | 7969 | SEQ ID NO: 18 in WO2013142034 |
| MESOTHELIN CAR | 7970 | SEQ ID NO: 19 in WO2013142034 |
| MESOTHELIN CAR | 7971 | SEQ ID NO: 20 in WO2013142034 |
| MESOTHELIN CAR | 7972 | SEQ ID NO: 21 in WO2013142034 |
| MESOTHELIN CAR | 7973 | SEQ ID NO: 22 in WO2013142034 |
| MESOTHELIN CAR | 7974 | SEQ ID NO: 23 in WO2013142034 |
| Mesothelin CAR | 7975 | SEQ ID NO. 3 in WO2013067492 |
| MUC1 CAR | 7976 | SEQ ID NO. 5 in WO2013063419 |
| MUC1 CAR | 7977 | SEQ ID NO. 7 in WO2013063419 |
| MUC1 CAR | 7978 | SEQ ID NO. 51 in US20160340406A1 |
| MUC1 CAR | 7979 | SEQ ID NO. 30 in US20160130357 |
| MUC1 CAR | 7980 | SEQ ID NO. 32 in US20160130357 |
| MUC1 CAR | 7981 | SEQ ID NO. 34 in US20160130357 |
| MUC1 CAR | 7982 | SEQ ID NO. 295 in WO2016130726 |
| MUC1 CAR | 7983 | SEQ ID NO. 298 in WO2016130726 |
| MUC1 CAR | 7984 | SEQ ID NO. 301 in WO2016130726 |
| MUC1 CAR | 7985 | SEQ ID NO. 304 in WO2016130726 |
| MUC1 CAR | 7986 | SEQ ID NO. 307 in WO2016130726 |
| MUC1 CAR | 7987 | SEQ ID NO. 607 in WO2016130726 |
| MUC1 CAR | 7988 | SEQ ID NO. 609 in WO2016130726 |
| MUC1 CAR | 7989 | SEQ ID NO. 611 in WO2016130726 |
| MUC1 CAR | 7990 | SEQ ID NO. 613 in WO2016130726 |
| NCAR with RQR82ACD19CAR | 7991 | SEQ ID NO. 615 in WO2016130726 |
| NYBR1 CAR | 7992 | SEQ ID NO. 617 in WO2016130726 |
| NYBR1 CAR | 7993 | SEQ ID NO. 619 in WO2016130726 |
| NYBR1 CAR | 7994 | SEQ ID NO: 218 in WO2016097231 |
| NYBR1 CAR | 7995 | SEQ ID NO. 26 in WO2015112830 |
| NYBR1 CAR | 7996 | SEQ ID NO. 29 in WO2015112830 |
| NYBR1 CAR | 7997 | SEQ ID NO. 60 in WO2015112830 |
| NYBR1 CAR | 7998 | SEQ ID NO: 1 in US20160333422A1 |
| P5A CAR | 7999 | SEQ ID NO: 26 in US20160333422A1 |
| P5A CAR | 8000 | SEQ ID NO: 29 in US20160333422A1 |
| P5A CAR | 8001 | SEQ ID NO: 60 in US20160333422A1 |
| P5AC1 CAR | 8002 | SEQ ID NO: 343 in US20160297884A1 |
| P5AC1 CAR | 8003 | SEQ ID NO: 344 in US20160297884A1 |
| P5AC1 CAR | 8004 | SEQ ID NO: 345 in US20160297884A1 |
| P5AC1 CAR | 8005 | SEQ ID NO: 346 in US20160297884A1 |
| P5AC16 CAR | 8006 | SEQ ID NO: 347 in US20160297884A1 |
| P5AC16 CAR | 8007 | SEQ ID NO: 396 in US20160297884A1 |
| P5AC16 CAR | 8008 | SEQ ID NO: 348 in US20160297884A1 |
| P6AP CAR | 8009 | SEQ ID NO: 349 in US20160297884A1 |
| P6AP CAR | 8010 | SEQ ID NO: 350 in US20160297884A1 |
| P6AP CAR | 8011 | SEQ ID NO: 351 in US20160297884A1 |
| P6DY CAR | 8012 | SEQ ID NO: 364 in US20160297884A1 |
| P6DY CAR | 8013 | SEQ ID NO: 365 in US20160297884A1 |
| P6DY CAR | 8014 | SEQ ID NO: 366 in US20160297884A1 |
| PC1 CAR | 8015 | SEQ ID NO: 361 in US20160297884A1 |
| PC1 CAR | 8016 | SEQ ID NO: 362 in US20160297884A1 |
| PC1 CAR | 8017 | SEQ ID NO: 363 in US20160297884A1 |
| PC1C12 CAR | 8018 | SEQ ID NO: 352 in US20160297884A1 |
| PC1C12 CAR | 8019 | SEQ ID NO: 353 in US20160297884A1 |
| PC1C12 CAR | 8020 | SEQ ID NO: 354 in US20160297884A1 |
| PD1 CAR | 8021 | SEQ ID NO: 355 in US20160297884A1 |
| PD1 CAR | 8022 | SEQ ID NO: 356 in US20160297884A1 |
| PD1 CAR | 8023 | SEQ ID NO: 357 in US20160297884A1 |
| PD1 CAR | 8024 | SEQ ID NO. 119 in WO2014153270 |
| PD1 CAR | 8025 | SEQ ID NO. 121 in WO2014153270 |
| PD1 CAR | 8026 | SEQ ID NO: 22 in US20160311917A1 |
| PD1 CAR | 8027 | SEQ ID NO: 24 in US20160311917A1 |
| PD1 CAR | 8028 | SEQ ID NO: 63 in US20160311917A1 |
| PD1 CAR | 8029 | SEQ ID NO: 64 in US20160311917A1 |
| PD1 CAR | 8030 | SEQ ID NO: 65 in US20160311917A1 |
| PD1 CAR | 8031 | SEQ ID NO: 66 in US20160311917A1 |
| PD1 CAR | 8032 | SEQ ID NO: 67 in US20160311917A1 |
| PD1 CAR | 8033 | SEQ ID NO: 68 in US20160311917A1 |
| PD1 CAR | 8034 | SEQ ID NO: 69 in US20160311917A1 |
| PD1 CAR | 8035 | SEQ ID NO: 70 in US20160311917A1 |
| PD1 CAR | 8036 | SEQ ID NO: 71 in US20160311917A1 |
| PD1 CAR | 8037 | SEQ ID NO: 72 in US20160311917A1 |

TABLE 16-continued

CAR sequences

| Description | SEQ ID NO | Source |
|---|---|---|
| PD1 CAR | 8038 | SEQ ID NO: 73 in US20160311917A1 |
| PD1 CAR | 8039 | SEQ ID NO: 74 in US20160311917A1 |
| PD1 CAR | 8040 | SEQ ID NO: 75 in US20160311917A1 |
| PD1 CAR | 8041 | SEQ ID NO: 76 in US20160311917A1 |
| PD1 CAR | 8042 | SEQ ID NO: 77 in US20160311917A1 |
| PD1 CAR | 8043 | SEQ ID NO: 78 in US20160311917A1 |
| PD1 CAR | 8044 | SEQ ID NO: 79 in US20160311917A1 |
| PD1 CAR | 8045 | SEQ ID NO: 80 in US20160311917A1 |
| PD1 CAR | 8046 | SEQ ID NO: 81 in US20160311917A1 |
| PD1 CAR | 8047 | SEQ ID NO: 82 in US20160311917A1 |
| PD1 CAR | 8048 | SEQ ID NO: 83 in US20160311917A1 |
| PD1 CAR | 8049 | SEQ ID NO: 84 in US20160311917A1 |
| PD1 CAR | 8050 | SEQ ID NO: 85 in US20160311917A1 |
| PD1 CAR | 8051 | SEQ ID NO: 86 in US20160311917A1 |
| PD1 CAR | 8052 | SEQ ID NO: 26 in WO2016172537A1 |
| PD1 CAR | 8053 | SEQ ID NO: 39 in WO2016172537A1 |
| PD1 CAR | 8054 | SEQ ID NO: 40 in US20160311907A1 |
| PD1 CAR | 8055 | SEQ ID. NO. 121 in WO2015157252 |
| PD1 CAR | 8056 | SEQ ID. NO. 119 in WO2015157252 |
| PD1 CAR | 8057 | SEQ ID NO. 24 (WO2016014565) |
| PD1 CAR | 8058 | SEQ ID NO. 22 (WO2016014565) |
| PD1 FKBP RCAR | 8059 | SEQ ID NO. 23 (WO2016014565) |
| PD1 FKBP RCAR | 8060 | SEQ ID NO. 26 in WO2015142675 |
| PSMA NCAR | 8061 | SEQ ID NO. 39 in WO2015142675 |
| PSMA NCAR | 8062 | SEQ ID NO: 28 in US20160311907A1 |
| PSMA NCAR | 8063 | SEQ ID NO: 29 in US20160311907A1 |
| PSMA NCAR | 8064 | SEQ ID NO: 140 in WO2016097231 |
| PSMA NCAR | 8065 | SEQ ID NO: 144 in WO2016097231 |
| PSMA NCAR | 8066 | SEQ ID NO: 145 in WO2016097231 |
| PSMA NCAR | 8067 | SEQ ID NO: 146 in WO2016097231 |
| PSMA NCAR | 8068 | SEQ ID NO: 147 in WO2016097231 |
| PSMA NCAR | 8069 | SEQ ID NO: 148 in WO2016097231 |
| PSMA NCAR | 8070 | SEQ ID NO: 149 in WO2016097231 |
| PSMA NCAR | 8071 | SEQ ID NO: 150 in WO2016097231 |
| PSMA NCAR | 8072 | SEQ ID NO: 167 in WO2016097231 |
| PSMA NCAR | 8073 | SEQ ID NO: 168 in WO2016097231 |
| PSMA NCAR | 8074 | SEQ ID NO. 169 in WO2016097231 |
| PSMA NCAR | 8075 | SEQ ID NO: 170 in WO2016097231 |
| PSMA NCAR | 8076 | SEQ ID NO: 171 in WO2016097231 |
| PSMA NCAR | 8077 | SEQ ID NO: 172 in WO2016097231 |
| PSMA NCAR | 8078 | SEQ ID NO: 173 in WO2016097231 |
| PSMA NCAR | 8079 | SEQ ID NO: 174 in WO2016097231 |
| PSMA NCAR | 8080 | SEQ ID NO: 151 in WO2016097231 |
| PSMA NCAR | 8081 | SEQ ID NO: 152 in WO2016097231 |
| PSMA NCAR | 8082 | SEQ ID NO: 153 in WO2016097231 |
| PSMA NCAR | 8083 | SEQ ID NO: 154 in WO2016097231 |
| PSMA NCAR | 8084 | SEQ ID NO: 155 in WO2016097231 |
| PSMA NCAR | 8085 | SEQ ID NO: 156 in WO2016097231 |
| PSMA NCAR | 8086 | SEQ ID NO: 139 in WO2016097231 |
| PSMA NCAR | 8087 | SEQ ID NO: 138 in WO2016097231 |
| PSMA NCAR | 8088 | SEQ ID NO: 175 in WO2016097231 |
| PSMA NCAR | 8089 | SEQ ID NO: 157 in WO2016097231 |
| PSMA NCAR | 8090 | SEQ ID NO: 158 in WO2016097231 |
| PSMA NCAR | 8091 | SEQ ID NO: 159 in WO2016097231 |
| PSMA NCAR | 8092 | SEQ ID NO: 160 in WO2016097231 |
| PSMA NCAR | 8093 | SEQ ID NO: 161 in WO2016097231 |
| PSMA NCAR | 8094 | SEQ ID NO: 162 in WO2016097231 |
| PSMA NCAR | 8095 | SEQ ID NO: 163 in WO2016097231 |
| PSMA NCAR | 8096 | SEQ ID NO: 164 in WO2016097231 |
| PSMA NCAR | 8097 | SEQ ID NO: 165 in WO2016097231 |
| PSMA NCAR | 8098 | SEQ ID NO: 166 in WO2016097231 |
| PSMA NCAR | 8099 | SEQ ID NO: 141 in WO2016097231 |
| PSMA NCAR | 8100 | SEQ ID NO: 142 in WO2016097231 |
| PSMA NCAR | 8101 | SEQ ID NO: 143 in WO2016097231 |
| PSMA NCAR | 8102 | SEQ ID NO: 214 in WO2016097231 |
| ROR1 CAR | 8103 | SEQ ID NO: 216 in WO2016097231 |
| ROR1 CAR | 8104 | SEQ ID NO: 217 in WO2016097231 |
| ROR1 CAR | 8105 | SEQ ID NO: 215 in WO2016097231 |
| ROR1 CAR | 8106 | SEQ ID N0. 79 in WO2016016344A1 |
| ROR1 CAR | 8107 | SEQ ID N0. 80 in WO2016016344A1 |
| ROR1 CAR | 8108 | SEQ ID N0. 81 in WO2016016344A1 |
| ROR1 CAR | 8109 | SEQ ID N0. 82 in WO2016016344A1 |
| ROR1 CAR | 8110 | SEQ ID N0. 83 in WO2016016344A1 |
| ROR1 CAR | 8111 | SEQ ID N0. 84 in WO2016016344A1 |
| ROR1 CAR | 8112 | SEQ ID N0. 85 in WO2016016344A1 |
| ROR1 CAR | 8113 | SEQ ID N0. 86 in WO2016016344A1 |

TABLE 16-continued

| CAR sequences | | |
|---|---|---|
| Description | SEQ ID NO | Source |
| ROR1 CAR | 8114 | SEQ ID N0. 87 in WO2016016344A1 |
| ROR1 CAR | 8115 | SEQ ID N0. 88 in WO2016016344A1 |
| ROR1 CAR | 8116 | SEQ ID N0. 89 in WO2016016344A1 |
| ROR1 CAR | 8117 | SEQ ID N0. 90 in WO2016016344A1 |
| ROR1 CAR | 8118 | SEQ ID N0. 91 in WO2016016344A1 |
| ROR1 CAR | 8119 | SEQ ID N0. 92 in WO2016016344A1 |
| ROR1 CAR | 8120 | SEQ ID N0. 93 in WO2016016344A1 |
| ROR1 CAR | 8121 | SEQ ID N0. 94 in WO2016016344A1 |
| ROR1 CAR | 8122 | SEQ ID N0. 95 in WO2016016344A1 |
| ROR1 CAR | 8123 | SEQ ID N0. 96 in WO2016016344A1 |
| ROR1 CAR | 8124 | SEQ ID N0. 103 in WO2016016344A1 |
| ROR1 CAR | 8125 | SEQ ID N0. 104 in WO2016016344A1 |
| ROR1 CAR | 8126 | SEQ ID N0. 105 in WO2016016344A1 |
| ROR1 CAR | 8127 | SEQ ID N0. 106 in WO2016016344A1 |
| ROR1 CAR | 8128 | SEQ ID N0. 107 in WO2016016344A1 |
| ROR1 CAR | 8129 | SEQ ID N0. 108 in WO2016016344A1 |
| ROR1 CAR | 8130 | SEQ ID N0. 109 in WO2016016344A1 |
| ROR1 CAR | 8131 | SEQ ID N0. 110 in WO2016016344A1 |
| ROR1 CAR | 8132 | SEQ ID N0. 111 in WO2016016344A1 |
| ROR1 CAR | 8133 | SEQ ID N0. 112 in WO2016016344A1 |
| ROR1 CAR | 8134 | SEQ ID N0. 113 in WO2016016344A1 |
| ROR1 CAR | 8135 | SEQ ID N0. 114 in WO2016016344A1 |
| ROR1 CAR | 8136 | SEQ ID N0. 115 in WO2016016344A1 |
| ROR1 CAR | 8137 | SEQ ID N0. 116 in WO2016016344A1 |
| ROR1 CAR | 8138 | SEQ ID N0. 117 in WO2016016344A1 |
| ROR1 CAR | 8139 | SEQ ID N0. 118 in WO2016016344A1 |
| ROR1 CAR | 8140 | SEQ ID N0. 119 in WO2016016344A1 |
| ROR1 CAR | 8141 | SEQ ID N0. 120 in WO2016016344A1 |
| ROR1 CAR | 8142 | SEQ ID N0. 127 in WO2016016344A1 |
| ROR1 CAR | 8143 | SEQ ID N0. 128 in WO2016016344A1 |
| ROR1 CAR | 8144 | SEQ ID N0. 129 in WO2016016344A1 |
| ROR1 CAR | 8145 | SEQ ID N0. 130 in WO2016016344A1 |
| ROR1 CAR | 8146 | SEQ ID N0. 131 in WO2016016344A1 |
| ROR1 CAR | 8147 | SEQ ID N0. 132 in WO2016016344A1 |
| ROR1 CAR | 8148 | SEQ ID N0. 133 in WO2016016344A1 |
| ROR1 CAR | 8149 | SEQ ID N0. 134 in WO2016016344A1 |
| ROR1 CAR | 8150 | SEQ ID N0. 135 in WO2016016344A1 |
| ROR1 CAR | 8151 | SEQ ID N0. 136 in WO2016016344A1 |
| ROR1 CAR | 8152 | SEQ ID N0. 137 in WO2016016344A1 |
| ROR1 CAR | 8153 | SEQ ID N0. 138 in WO2016016344A1 |
| ROR1 CAR | 8154 | SEQ ID N0. 97 in WO2016016344A1 |
| ROR1 CAR | 8155 | SEQ ID N0. 98 in WO2016016344A1 |
| ROR1 CAR | 8156 | SEQ ID N0. 99 in WO2016016344A1 |
| ROR1 CAR | 8157 | SEQ ID N0. 100 in WO2016016344A1 |
| ROR1 CAR | 8158 | SEQ ID N0. 101 in WO2016016344A1 |
| ROR1 CAR | 8159 | SEQ ID N0. 102 in WO2016016344A1 |
| ROR1 CAR | 8160 | SEQ ID N0. 121 in WO2016016344A1 |
| ROR1 CAR | 8161 | SEQ ID N0. 122 in WO2016016344A1 |
| ROR1 CAR | 8162 | SEQ ID N0. 123 in WO2016016344A1 |
| ROR1 CAR | 8163 | SEQ ID N0. 124 in WO2016016344A1 |
| ROR1 CAR | 8164 | SEQ ID N0. 125 in WO2016016344A1 |
| ROR1 CAR | 8165 | SEQ ID N0. 126 in WO2016016344A1 |
| ROR1 CAR | 8166 | SEQ ID NO: 386 in WO2016187216A1 |
| ROR1 CAR | 8167 | SEQ ID NO: 387 in WO2016187216A1 |
| ROR1 CAR | 8168 | SEQ ID NO: 388 in WO2016187216A1 |
| ROR1 CAR | 8169 | SEQ ID NO: 389 in WO2016187216A1 |
| ROR1 CAR | 8170 | SEQ ID NO: 390 in WO2016187216A1 |
| ROR1 CAR | 8171 | SEQ ID NO: 391 in WO2016187216A1 |
| ROR1 CAR | 8172 | SEQ ID NO: 392 in WO2016187216A1 |
| ROR1 CAR | 8173 | SEQ ID NO: 393 in WO2016187216A1 |
| ROR1 CAR | 8174 | SEQ ID NO: 394 in WO2016187216A1 |
| SNAP CAR | 8175 | SEQ ID NO: 395 in WO2016187216A1 |
| SSEA4CAR | 8176 | SEQ ID NO: 396 in WO2016187216A1 |
| SSEA4CAR | 8177 | SEQ ID NO: 397 in WO2016187216A1 |
| Tan CAR (a CAR AND GATE which recognizes CD19 AND CD33 using a CD45 phosphatase) | 8178 | SEQ ID NO: 19 in US20160311907A1 |

TABLE 16-continued

CAR sequences

| Description | SEQ ID NO | Source |
|---|---|---|
| Tan CAR (a CAR AND gate which recognizes CD19 AND CD33 using a CD148 phosphatase) | 8179 | SEQ ID NO. 5 in WO2016026742A1 |
| Tan CAR (a CAR AND NOT gate which recognizes CD19 AND NOT CD33 and is based on an ITIM containing endodomain from LAIR1) | 8180 | SEQ ID NO. 6 in WO2016026742A1 |
| Tan CAR (a CAR AND NOT GATE which recognizes CD19 AND NOT CD33 based on PTPN6 phosphatase) | 8181 | SEQ ID NO. 3 in WO2015075468 |
| Tan CAR (a CAR AND NOT gate which recognizes CD19 AND NOT CD33 and recruits a PTPN6CD148 fusion protein to an ITIM containing endodomain) | 8182 | SEQ ID NO. 2 in WO2015075468 |
| TOSO CAR | 8183 | SEQ ID NO. 5 in WO2015075468 |
| TOSO CAR | 8184 | SEQ ID NO. 4 in WO2015075468 |
| Trophoblast Glycoprotein 5T4 CAR | 8185 | SEQ ID NO. 6 in WO2015075468 |
| Trophoblast Glycoprotein 5T4 CAR | 8186 | SEQ ID No. 4 in US20160347854A1 |
| Trophoblast Glycoprotein 5T4 CAR | 8187 | SEQ ID No. 4 in EP3098237A1 |
| Trophoblast Glycoprotein 5T4 CAR | 8188 | SEQ ID N0. 19 in WO2016034666A1 |
| Trophoblast Glycoprotein 5T4 CAR | 8189 | SEQ ID N0. 20 in WO2016034666A1 |
| Trophoblast Glycoprotein 5T4 CAR | 8190 | SEQ ID N0. 21 in WO2016034666A1 |
| Trophoblast Glycoprotein 5T4 CAR | 8191 | SEQ ID N0. 22 in WO2016034666A1 |
| Trophoblast Glycoprotein 5T4 CAR | 8192 | SEQ ID N0. 23 in WO2016034666A1 |
| Trophoblast Glycoprotein 5T4 CAR | 8193 | SEQ ID N0. 24 in WO2016034666A1 |
| Trophoblast Glycoprotein 5T4 CAR | 8194 | SEQ ID N0. 25 in WO2016034666A1 |
| Trophoblast Glycoprotein 5T4 CAR | 8195 | SEQ ID N0. 26 in WO2016034666A1 |
| Trophoblast Glycoprotein 5T4 CAR | 8196 | SEQ ID N0. 27 in WO2016034666A1 |
| Trophoblast Glycoprotein 5T4 CAR | 8197 | SEQ ID N0. 28 in WO2016034666A1 |
| Trophoblast Glycoprotein 5T4 CAR | 8198 | SEQ ID N0. 29 in WO2016034666A1 |
| Trophoblast Glycoprotein 5T4 CAR | 8199 | SEQ ID N0. 30 in WO2016034666A1 |
| Trophoblast Glycoprotein 5T4 CAR | 8200 | SEQ ID N0. 31 in WO2016034666A1 |
| Trophoblast Glycoprotein 5T4 CAR | 8201 | SEQ ID N0. 32 in WO2016034666A1 |
| Trophoblast Glycoprotein 5T4 CAR | 8202 | SEQ ID N0. 33 in WO2016034666A1 |
| Trophoblast Glycoprotein 5T4 CAR | 8203 | SEQ ID N0. 34 in WO2016034666A1 |
| Trophoblast Glycoprotein 5T4 CAR | 8204 | SEQ ID N0. 35 in WO2016034666A1 |
| Trophoblast Glycoprotein 5T4 CAR | 8205 | SEQ ID N0. 36 in WO2016034666A1 |
| Trophoblast Glycoprotein 5T4 CAR | 8206 | SEQ ID N0. 37 in WO2016034666A1 |
| Trophoblast Glycoprotein 5T4 CAR | 8207 | SEQ ID N0. 38 in WO2016034666A1 |
| Trophoblast Glycoprotein 5T4 CAR | 8208 | SEQ ID N0. 39 in WO2016034666A1 |
| TSLPR CAR | 8209 | SEQ ID N0. 40 in WO2016034666A1 |
| TSLPR CAR | 8210 | SEQ ID N0. 41 in WO2016034666A1 |
| TSLPR CAR | 8211 | SEQ ID N0. 42 in WO2016034666A1 |
| TSLPR CAR | 8212 | SEQ ID NO. 39 in WO2015084513 |
| TSLPR CAR | 8213 | SEQ ID NO. 40 in WO2015084513 |
| TSLPR CAR | 8214 | SEQ ID NO. 41 in WO2015084513 |
| TSLPR CAR | 8215 | SEQ ID NO. 42 in WO2015084513 |
| TSLPR CAR | 8216 | SEQ ID NO. 43 in WO2015084513 |
| TSLPR CAR | 8217 | SEQ ID NO. 44 in WO2015084513 |
| TSLPR CAR | 8218 | SEQ ID NO. 45 in WO2015084513 |
| TSLPR CAR | 8219 | SEQ ID NO. 46 in WO2015084513 |
| TSLPR CAR | 8220 | SEQ ID NO: 39 in US20160311910A1 |
| TSLPR CAR | 8221 | SEQ ID NO: 40 in US20160311910A1 |
| TSLPR CAR | 8222 | SEQ ID NO: 41 in US20160311910A1 |
| TSLPR CAR | 8223 | SEQ ID NO: 42 in US20160311910A1 |
| TSLPR CAR | 8224 | SEQ ID NO: 43 in US20160311910A1 |
| VEGFR2 CAR | 8225 | SEQ ID NO: 44 in US20160311910A1 |
| VEGFR2 CAR | 8226 | SEQ ID NO: 45 in US20160311910A1 |
| VEGFR2 CAR | 8227 | SEQ ID NO: 46 in US20160311910A1 |
| VEGFR2 CAR | 8228 | SEQ ID NO. 10 in US20120213783 |
| VEGFR2 CAR | 8229 | SEQ ID NO. 11 in US20120213783 |
| VEGFR2 CAR | 8230 | SEQ ID NO. 12 in US20120213783 |
| αfolate receptor (FRα) CAR | 8231 | SEQ ID NO. 13 in US20120213783 |
| αfolate receptor (FRα) CAR | 8232 | SEQ ID NO. 14 in US20120213783 |

In one embodiment of the present invention, the payload of the invention is a CD19 specific CAR targeting different B cell malignancies and HER2-specific CAR targeting sarcoma, glioblastoma, and advanced Her2-positive lung malignancy.

In some embodiments, the CAR is a CD19 CAR. The amino acid sequences of CD19 CAR components and CD19 CAR constructs are presented in Table 17A and Table 17B. Table 17B also provides alternate aliases for a given construct ID. These aliases are identified by the prefix OT.

TABLE 17A

CD19 CAR construct components

| Description | Amino Acid Sequence | AA SEQ ID NO | NA SEQ ID NO |
|---|---|---|---|
| CD19 scFv | DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS | 8233 | 8241-8246 |
| CD8a hinge | TTTPAPRPPTPAPTIASQPLSLRPEACRPAAGGAVHTRGLDFACD | 8234 | 8247-8251 |
| CD8a hinge-TM (hinge and transmembrane) | TTTPAPRPPTPAPTIASQPLSLRPEACRPAAGGAVHTRGLDFACDIYIWAPLAGTCGVLLLSLVITLYC | 8235 | 8252-8254 |
| CD3 zeta signaling domain | RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR | 8236 | 8255-8261 |
| 4-1BB intracellular signaling domain; CD28 co-stimulatory domain; | KRGRKKLLYIFKQPFMRPVQTTQEEDGCSCRFPEEEEGGCEL | 8237 | 8262-8267 |
| CD8a leader | MALPVTALLLPLALLLHAARP | 278 | 279-283 |
| hPDE5 (Amino acid 535-860 of WT) | EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVAIEFFDQGDRERKELNIEPTDLMNREKKNKIPSMQVGFIDAICLQLYEALTHVSEDCFPLLDGCRKNRQKWQALAEQQ | 3 | 339 |
| hPDE5 (Amino acid 535-860 of WT, R732L) | EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVAIEFFDQGDRERKELNIEPTDLMNREKKNKIPSMQVGFIDAICLQLYEALTHVSEDCFPLLDGCRKNRQKWQALAEQQ | 12 | 359 |
| hPDE5 (Amino acid 535-860 of WT, R732L, D764N) | EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACNLSAITKPWPIQQRIAELVAIEFFDQGDRERKELNIEPTDLMNREKKNKIPSMQVGFIDAICLQLYEALTHVSEDCFPLLDGCRKNRQKWQALAEQQ | 505 | 520 |
| hPDE5 (Amino acid 535-860 of WT, R732L, F736A) | EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVAIEFFDQGDRERKELNIEPTDLMNREKKNKIPSMQVGFIDAICLQLYEALTHVSEDCFPLLDGCRKNRQKWQALAEQQ | 227 | 233 |

TABLE 17A-continued

CD19 CAR construct components

| Description | Amino Acid Sequence | AA SEQ ID NO | NA SEQ ID NO |
|---|---|---|---|
| hPDE5 (Amino acid 535-860 of WT, H653A) | EETRELQSLAAAVVPSAQTLKITDFSFSDFELSDLETAL CTIRMFTDLNLVQNFQMKHEVLCRWILSVKKNYRKN VAYHNWRHAFNTAQCMFAALKAGKIQNKLTDLEILA LLIAALSADLDHRGVNNSYIQRSEHPLAQLYCHSIMEH HHFDQCLMILNSPGNQILSGLSIEEYKTTLKIIKQAILA TDLALYIKRRGEFFELIRKNQFNLEDPHQKELFLAML MTACDLSAITKPWPIQQRIAELVAIEFFDQGDRERKEL NIEPTDLMNREKKNKIPSMQVGFIDAICLQLYEALTHV SEDCFPLLDGCRKNRQKWQALAEQQ | 348 | 361 |
| hPDE5 (Amino acid 535-860 of WT, R732L, H653A) | EETRELQSLAAAVVPSAQTLKITDFSFSDFELSDLETAL CTIRMFTDLNLVQNFQMKHEVLCRWILSVKKNYRKN VAYHNWRHAFNTAQCMFAALKAGKIQNKLTDLEILA LLIAALSADLDHRGVNNSYIQRSEHPLAQLYCHSIMEH HHFDQCLMILNSPGNQILSGLSIEEYKTTLKIIKQAILA TDLALYIKRLGEFFELIRKNQFNLEDPHQKELFLAML MTACDLSAITKPWPIQQRIAELVAIEFFDQGDRERKEL NIEPTDLMNREKKNKIPSMQVGFIDAICLQLYEALTHV SEDCFPLLDGCRKNRQKWQALAEQQ | 509 | 524 |
| hPDE5 (Amino acid 535-860 of WT, R732L, D764A) | EETRELQSLAAAVVPSAQTLKITDFSFSDFELSDLETAL CTIRMFTDLNLVQNFQMKHEVLCRWILSVKKNYRKN VAYHNWRHAFNTAQCMFAALKAGKIQNKLTDLEILA LLIAALSHDLDHRGVNNSYIQRSEHPLAQLYCHSIMEH HHFDQCLMILNSPGNQILSGLSIEEYKTTLKIIKQAILA TDLALYIKRLGEFFELIRKNQFNLEDPHQKELFLAML MTACALSAITKPWPIQQRIAELVAIEFFDQGDRERKEL NIEPTDLMNREKKNKIPSMQVGFIDAICLQLYEALTHV SEDCFPLLDGCRKNRQKWQALAEQQ | 510 | 525 |
| HA Tag | YPYDVPDYA | 8238 | 8268 |
| P2A Cleavable peptide | GATNFSLLKQAGDVEENPGP | 8239 | 8270 |
| mCherry (M1L) | LSKGEEDNMAIIKEFMRFKVHMEGSVNGHEFEIEGEG EGRPYEGTQTAKLKVTKGGPLPFAWDILSPQFMYGSK AYVKHPADIPDYLKLSFPEGFKWERVMNFEDGGVVT VTQDSSLQDGEFIYKVKLRGTNFPSDGPVMQKKTMG WEASSERMYPEDGALKGEIKQRLKLKDGGHYDAEVK TTYKAKKPVQLPGAYNVNIKLDITSHNEDYTIVEQYE RAEGRHSTGGMDELYK | 8240 | 8269 |
| SG LINKER | SG | — | AGTGGT |
| Linker (GSG) (BamH1-Gly) | GSG | — | GGATCCGGA |
| Flexible G/S rich linker; BamH1 Site | GS | — | GGATCC |
| Lys-Asp Acid Linker | LD | — | CTAGAT |

TABLE 17B

CD19 CARs constructs

| Description | Amino Acid Sequence | AA SEQ ID NO | NA SEQ ID NO |
|---|---|---|---|
| OT-CD19-063 (OT-001407) CD8a leader; CD19 scFv; CD8a Hinge and Tmnsmembrane | MALPVTALLLPLALLLHAARPDIQMTQTTSSLSASLG DRVTISCRASQDISKYLNWYQQKPDGTVKLLIYHTSR LHSGVPSRFSGSGSGTDYSLTISNLEQEDIATYFCQQG NTLPYTFGGGTKLEITGGGGSGGGGSGGGGSEVKLQ ESGPGLVAPSQSLSVTCTVSGVSLPDYGVSWIRQPPR KGLEWLGVIWGSETTYYNSALKSRLTIIKDNSKSQVF | 8271 | 8285 |

TABLE 17B-continued

CD19 CARs constructs

| Description | Amino Acid Sequence | AA SEQ ID NO | NA SEQ ID NO |
|---|---|---|---|
| Domain; 4-1BB intracellular domain; CD3 zeta signaling domain; stop | LKMNSLQTDDTAIYYCAKHYYYGGSYAMDYWGQG TSVTVSSTTTPAPRPPTPAPTIASQPLSLRPEACRPAAG GAVHTRGLDFACDIYIWAPLAGTCGVLLLSLVITLYC KRGRKKLLYIFKQPFMRPVQTTQEEDGCSCRFPEEEE GGCELRVKFSRSADAPAYKQGQNQLYNELNLGRRE EYDVLDKRRGRDPEMGGKPRRKNPQEGLYNELQKD KMAEAYSEIGMKGERRRGKGHDGLYQGLSTATKDT YDALHMQALPPR* | | |
| OT-CD19-037 (OT-001258) CD8a leader; CD19 scFV; CD8a-Tm; (4-1BB intracellular domain); CD3zeta signaling domain; Linker (GSG), hPDE5 (Amino acid 535-860 of WT, R732L, D764N), stop | MALPVTALLLPLALLLHAARPDIQMTQTTSSLSASLG DRVTISCRASQDISKYLNWYQQKPDGTVKLLIYHTSR LHSGVPSRFSGSGSGTDYSLTISNLEQEDIATYFCQQG NTLPYTFGGGTKLEITGGGGSGGGGSGGGGSEVKLQ ESGPGLVAPSQSLSVTCTVSGVSLPDYGVSWIRQPPR KGLEWLGVIWGSETTYYNSALKSRLTIIKDNSKSQVF LKMNSLQTDDTAIYYCAKHYYYGGSYAMDYWGQG TSVTVSSTTTPAPRPPTPAPTIASQPLSLRPEACRPAAG GAVHTRGLDFACDIYIWAPLAGTCGVLLLSLVITLYC KRGRKKLLYIFKQPFMRPVQTTQEEDGCSCRFPEEEE GGCELRVKFSRSADAPAYKQGQNQLYNELNLGRRE EYDVLDKRRGRDPEMGGKPRRKNPQEGLYNELQKD KMAEAYSEIGMKGERRRGKGHDGLYQGLSTATKDT YDALHMQALPPRGSGEETRELQSLAAAVVPSAQTLK ITDFSFSDFELSDLETALCTIRMFTDLNLVQNFQMKH EVLCRWILSVKKNYRKNVAYHNWRHAFNTAQCMF AALKAGKIQNKLTDLEILALLIAALSHDLDHRGVNNS YIQRSEHPLAQLYCHSIMEHHHFDQCLMILNSPGNQI LSGLSIEEYKTTLKIIKQAILATDLALYIKRLGEFFELIR KNQFNLEDPHQKELFLAMLMTACNLSAITKPWPIQQ RIAELVATEFFDQGDRERKELNIEPTDLMNREKKNKI PSMQVGFIDAICLQLYEALTHVSEDCFPLLDGCRKNR QKWQALAEQQ* | 8272 | 8286 |
| OT-CD19-045 (OT-001298) CD8a leader; CD19 scFV; CD8a-Tm; (4-1BB intracellular domain); CD3zeta signaling domain; Linker (GSG); hPDE5 (Amino acid 535-860 of WT, R732L, F736A); stop | MALPVTALLLPLALLLHAARPDIQMTQTTSSLSASLG DRVTISCRASQDISKYLNWYQQKPDGTVKLLIYHTSR LHSGVPSRFSGSGSGTDYSLTISNLEQEDIATYFCQQG NTLPYTFGGGTKLEITGGGGSGGGGSGGGGSEVKLQ ESGPGLVAPSQSLSVTCTVSGVSLPDYGVSWIRQPPR KGLEWLGVIWGSETTYYNSALKSRLTIIKDNSKSQVF LKMNSLQTDDTAIYYCAKHYYYGGSYAMDYWGQG TSVTVSSTTTPAPRPPTPAPTIASQPLSLRPEACRPAAG GAVHTRGLDFACDIYIWAPLAGTCGVLLLSLVITLYC KRGRKKLLYIFKQPFMRPVQTTQEEDGCSCRFPEEEE GGCELRVKFSRSADAPAYKQGQNQLYNELNLGRRE EYDVLDKRRGRDPEMGGKPRRKNPQEGLYNELQKD KMAEAYSEIGMKGERRRGKGHDGLYQGLSTATKDT YDALHMQALPPRGSGEETRELQSLAAAVVPSAQTLK ITDFSFSDFELSDLETALCTIRMFTDLNLVQNFQMKH EVLCRWILSVKKNYRKNVAYHNWRHAFNTAQCMF AALKAGKIQNKLTDLEILALLIAALSHDLDHRGVNNS YIQRSEHPLAQLYCHSIMEHHHFDQCLMILNSPGNQI LSGLSIEEYKTTLKIIKQAILATDLALYIKRLGEFAELI RKNQFNLEDPHQKELFLAMLMTACDLSAITKPWPIQ QRIAELVAIEFFDQGDRERKELNIEPTDLMNREKKN KIPSMQVGFIDAICLQLYEALTHVSEDCFPLLDGCRK NRQKWQALAEQQ* | 8273 | 8287 |
| OT-CD19-051 (OT-001299) CD8a leader; CD19 scFV; CD8a-Tm; (4-1BB intracellular domain); CD3zeta signaling domain; Linker (GSG); hPDE5 (Amino acid 535-860 of WT); stop | MALPVTALLLPLALLLHAARPDIQMTQTTSSLSASLG DRVTISCRASQDISKYLNWYQQKPDGTVKLLIYHTSR LHSGVPSRFSGSGSGTDYSLTISNLEQEDIATYFCQQG NTLPYTFGGGTKLEITGGGGSGGGGSGGGGSEVKLQ ESGPGLVAPSQSLSVTCTVSGVSLPDYGVSWIRQPPR KGLEWLGVIWGSETTYYNSALKSRLTIIKDNSKSQVF LKMNSLQTDDTAIYYCAKHYYYGGSYAMDYWGQG TSVTVSSTTTPAPRPPTPAPTIASQPLSLRPEACRPAAG GAVHTRGLDFACDIYIWAPLAGTCGVLLLSLVITLYC KRGRKKLLYIFKQPFMRPVQTTQEEDGCSCRFPEEEE GGCELRVKFSRSADAPAYKQGQNQLYNELNLGRRE EYDVLDKRRGRDPEMGGKPRRKNPQEGLYNELQKD KMAEAYSEIGMKGERRRGKGHDGLYQGLSTATKDT YDALHMQALPPRGSGEETRELQSLAAAVVPSAQTLK ITDFSFSDFELSDLETALCTIRMFTDLNLVQNFQMKH EVLCRWILSVKKNYRKNVAYHNWRHAFNTAQCMF AALKAGKIQNKLTDLEILALLIAALSHDLDHRGVNNS | 8274 | 8288 |

TABLE 17B-continued

CD19 CARs constructs

| Description | Amino Acid Sequence | AA SEQ ID NO | NA SEQ ID NO |
|---|---|---|---|
| | YIQRSEHPLAQLYCHSIMEHHHFDQCLMILNSPGNQI<br>LSGLSIEEYKTTLKIIKQAILATDLALYIKRRGEFFELI<br>RKNQFNLEDPHQKELFLAMLMTACDLSAITKPWPIQ<br>QRIAELVAIEFFDQGDRERKELNIEPTDLMNREKKN<br>KIPSMQVGFIDAICLQLYEALTHVSEDCFPLLDGCRK<br>NRQKWQALAEQQ* | | |
| OT-CD19-052<br>(OT-001300)<br>CD8a leader; HA<br>Tag; CD19 scFV;<br>CD8a-Tm; (4-<br>1BB intracellular<br>domain); CD3zeta<br>signaling domain;<br>Linker (SG);<br>hPDE5 (Amino<br>acid 535-860 of<br>WT); stop | MALPVTALLLPLALLLHAARPYPYDVPDYADIQMTQ<br>TTSSLSASLGDRVTISCRASQDISKYLNWYQQKPDGT<br>VKLLIYHTSRLHSGVPSRFSGSGSGTDYSLTISNLEQE<br>DIATYFCQQGNTLPYTFGGGTKLEITGGGGSGGGGS<br>GGGGSEVKLQESGPGLVAPSQSLSVTCTVSGVSLPDY<br>GVSWIRQPPRKGLEWLGVIWGSETTYYNSALKSRLTI<br>IKDNSKSQVFLKMNSLQTDDTAIYYCAKHYYYGGSY<br>AMDYWGQGTSVTVSSTTTPAPRPPTPAPTIASQPLSL<br>RPEACRPAAGGAVHTRGLDFACDIYIWAPLAGTCGV<br>LLLSLVITLYCKRGRKKLLYIFKQPFMRPVQTTQEED<br>GCSCRFPEEEEGGCELRVKFSRSADAPAYKQGQNQL<br>YNELNLGRREEYDVLDKRRGRDPEMGGKPRRKNPQ<br>EGLYNELQKDKMAEAYSEIGMKGERRRGKGHDGLY<br>QGLSTATKDTYDALHMQALPPRSGEETRELQSLAAA<br>VVPSAQTLKITDFSFSDFELSDLETALCTIRMFTDLNL<br>VQNFQMKHEVLCRWILSVKKNYRKNVAYHNWRHA<br>FNTAQCMFAALKAGKIQNKLTDLEILALLIAALSHDL<br>DHRGVNNSYIQRSEHPLAQLYCHSIMEHHHFDQCLM<br>ILNSPGNQILSGLSIEEYKTTLKIIKQAILATDLALYIKR<br>RGEFFELIRKNQFNLEDPHQKELFLAMLMTACDLSAI<br>TKPWPIQQRIAELVATEFFDQGDRERKELNIEPTDLM<br>NREKKNKIPSMQVGFIDAICLQLYEALTHVSEDCFPL<br>LDGCRKNRQKWQALAEQQ* | 8275 | 8289 |
| OT-CD19-053<br>(OT-001301)<br>CD8a leader; HA<br>Tag; CD19 scFV;<br>CD8a-Tm; (4-<br>1BB intracellular<br>domain); CD3zeta<br>signaling domain;<br>linker (SG);<br>hPDE5 (Amino<br>acid 535-860 of<br>WT, R732L); stop | MALPVTALLLPLALLLHAARPYPYDVPDYADIQMTQ<br>TTSSLSASLGDRVTISCRASQDISKYLNWYQQKPDGT<br>VKLLIYHTSRLHSGVPSRFSGSGSGTDYSLTISNLEQE<br>DIATYFCQQGNTLPYTFGGGTKLEITGGGGSGGGGS<br>GGGGSEVKLQESGPGLVAPSQSLSVTCTVSGVSLPDY<br>GVSWIRQPPRKGLEWLGVIWGSETTYYNSALKSRLTI<br>IKDNSKSQVFLKMNSLQTDDTAIYYCAKHYYYGGSY<br>AMDYWGQGTSVTVSSTTTPAPRPPTPAPTIASQPLSL<br>RPEACRPAAGGAVHTRGLDFACDIYIWAPLAGTCGV<br>LLLSLVITLYCKRGRKKLLYIFKQPFMRPVQTTQEED<br>GCSCRFPEEEEGGCELRVKFSRSADAPAYKQGQNQL<br>YNELNLGRREEYDVLDKRRGRDPEMGGKPRRKNPQ<br>EGLYNELQKDKMAEAYSEIGMKGERRRGKGHDGLY<br>QGLSTATKDTYDALHMQALPPRSGEETRELQSLAAA<br>VVPSAQTLKITDFSFSDFELSDLETALCTIRMFTDLNL<br>VQNFQMKHEVLCRWILSVKKNYRKNVAYHNWRHA<br>FNTAQCMFAALKAGKIQNKLTDLEILALLIAALSHDL<br>DHRGVNNSYIQRSEHPLAQLYCHSIMEHHHFDQCLM<br>ILNSPGNQILSGLSIEEYKTTLKIIKQAILATDLALYIKR<br>LGEFFELIRKNQFNLEDPHQKELFLAMLMTACDLSAI<br>TKPWPIQQRIAELVATEFFDQGDRERKELNIEPTDLM<br>NREKKNKIPSMQVGFIDAICLQLYEALTHVSEDCFPL<br>LDGCRKNRQKWQALAEQQ* | 8276 | 8290 |
| OT-CD19-067<br>(OT-001302)<br>CD8a leader;<br>CD19 scFV;<br>CD8a-Tm; (4-<br>1BB intracellular<br>domain); CD3zeta<br>signaling domain;<br>linker (GS);<br>hPDE5 (Amino<br>acid 535-860 of<br>WT, R732L,<br>F736A); linker<br>(GS); mCherry<br>(M1L); stop | MALPVTALLLPLALLLHAARPDIQMTQTTSSLSASLG<br>DRVTISCRASQDISKYLNWYQQKPDGTVKLLIYHTSR<br>LHSGVPSRFSGSGSGTDYSLTISNLEQEDIATYFCQQG<br>NTLPYTFGGGTKLEITGGGGSGGGGSGGGGSEVKLQ<br>ESGPGLVAPSQSLSVTCTVSGVSLPDYGVSWIRQPPR<br>KGLEWLGVIWGSETTYYNSALKSRLTIIKDNSKSQVF<br>LKMNSLQTDDTAIYYCAKHYYYGGSYAMDYWGQG<br>TSVTVSSTTTPAPRPPTPAPTIASQPLSLRPEACRPAAG<br>GAVHTRGLDFACDIYIWAPLAGTCGVLLLSLVITLYC<br>KRGRKKLLYIFKQPFMRPVQTTQEEDGCSCRFPEEEE<br>GGCELRVKFSRSADAPAYKQGQNQLYNELNLGRRE<br>EYDVLDKRRGRDPEMGGKPRRKNPQEGLYNELQKD<br>KMAEAYSEIGMKGERRRGKGHDGLYQGLSTATKDT<br>YDALHMQALPPRSGEETRELQSLAAAVVPSAQTLKI<br>TDFSFSDFELSDLETALCTIRMFTDLNLVQNFQMKHE<br>VLCRWILSVKKNYRKNVAYHNWRHAFNTAQCMFA<br>ALKAGKIQNKLTDLEILALLIAALSHDLDHRGVNNSY<br>IQRSEHPLAQLYCHSIMEHHHFDQCLMILNSPGNQILS<br>GLSIEEYKTTLKIIKQAILATDLALYIKRLGEFAELIRK | 8277 | 8291 |

TABLE 17B-continued

CD19 CARs constructs

| Description | Amino Acid Sequence | AA SEQ ID NO | NA SEQ ID NO |
|---|---|---|---|
| | NQFNLEDPHQKELFLAMLMTACDLSAITKPWPIQQRI AELVAIEFFDQGDRERKELNIEPTDLMNREKKNKIPS MQVGFIDAICLQLYEALTHVSEDCFPLLDGCRKNRQ KWQALAEQQGSLSKGEEDNMAIIKEFMRFKVHMEG SVNGHEFEIEGEGEGRPYEGTQTAKLKVTKGGPLPFA WDILSPQFMYGSKAYVKHPADIPDYLKLSFPEGFKW ERVMNFEDGGVVTVTQDSSLQDGEFIYKVKLRGTNF PSDGPVMQKKTMGWEASSERMYPEDGALKGEIKQR LKLKDGGHYDAEVKTTYKAKKPVQLPGAYNVNIKL DITSHNEDYTIVEQYERAEGRHSTGGMDELYK* | | |
| OT-CD19-078 (OT-001303) CD8a leader; CD19 scFV; CD8a-Tm; (4-1BB intracellular domain); CD3zeta signaling domain; linker (GS); hPDE5 (Amino acid 535-860 of WT, R732L, F736A); linker (GSG); P2A linker; mCherry (M1L); stop | MALPVTALLLPLALLLHAARPDIQMTQTTSSLSASLG DRVTISCRASQDISKYLNWYQQKPDGTVKLLIYHTSR LHSGVPSRFSGSGSGTDYSLTISNLEQEDIATYFCQQG NTLPYTFGGGTKLEITGGGGSGGGGSGGGGSEVKLQ ESGPGLVAPSQSLSVTCTVSGVSLPDYGVSWIRQPPR KGLEWLGVIWGSETTYYNSALKSRLTIIKDNSKSQVF LKMNSLQTDDTAIYYCAKHYYYGGSYAMDYWGQG TSVTVSSTTTPAPRPPTPAPTIASQPLSLRPEACRPAAG GAVHTRGLDFACDIYIWAPLAGTCGVLLLSLVITLYC KRGRKKLLYIFKQPFMRPVQTTQEEDGCSCRFPEEEE GGCELRVKFSRSADAPAYKQGQNQLYNELNLGRRE EYDVLDKRRGRDPEMGGKPRRKNPQEGLYNELQKD KMAEAYSEIGMKGERRRGKGHDGLYQGLSTATKDT YDALHMQALPPRGSEETRELQSLAAAVVPSAQTLKI TDFSFSDFELSDLETALCTIRMFTDLNLVQNFQMKHE VLCRWILSVKKNYRKNVAYHNWRHAFNTAQCMFA ALKAGKIQNKLTDLEILALLIAALSHDLDHRGVNNSY IQRSEHPLAQLYCHSIMEHHHFDQCLMILNSPGNQILS GLSIEEYKTTLKIIKQAILATDLALYIKRLGEFAELIRK NQFNLEDPHQKELFLAMLMTACDLSAITKPWPIQQRI AELVAIEFFDQGDRERKELNIEPTDLMNREKKNKIPS MQVGFIDAICLQLYEALTHVSEDCFPLLDGCRKNRQ KWQALAEQQGSGGATNFSLLKQAGDVEENPGPLSK GEEDNMAIIKEFMRFKVHMEGSVNGHEFEIEGEGEG RPYEGTQTAKLKVTKGGPLPFAWDILSPQFMYGSKA YVKHPADIPDYLKLSFPEGFKWERVMNFEDGGVVTV TQDSSLQDGEFIYKVKLRGTNFPSDGPVMQKKTMG WEASSERMYPEDGALKGEIKQRLKLKDGGHYDAEV KTTYKAKKPVQLPGAYNVNIKLDITSHNEDYTIVEQ YERAEGRHSTGGMDELYK* | 8278 | 8292 |
| OT-CD19-100 (OT-001304) CD8a leader; HA Tag; CD19 scFV; CD8a-Tm, (4-1BB intracellular domain); CD3zeta signaling domain; linker (GS); hPDE5 (Amino acid 535-860 of WT); linker (GS), Spacer (LD); P2A linker; mCherry (M1L); stop | MALPVTALLLPLALLLHAARPYPYDVPDYADIQMTQ TTSSLSASLGDRVTISCRASQDISKYLNWYQQKPDGT VKLLIYHTSRLHSGVPSRFSGSGSGTDYSLTISNLEQE DIATYFCQQGNTLPYTFGGGTKLEITGGGGSGGGGS GGGGSEVKLQESGPGLVAPSQSLSVTCTVSGVSLPDY GVSWIRQPPRKGLEWLGVIWGSETTYYNSALKSRLTI IKDNSKSQVFLKMNSLQTDDTAIYYCAKHYYYGGSY AMDYWGQGTSVTVSSTTTPAPRPPTPAPTIASQPLSL RPEACRPAAGGAVHTRGLDFACDIYIWAPLAGTCGV LLLSLVITLYCKRGRKKLLYIFKQPFMRPVQTTQEED GCSCRFPEEEEGGCELRVKFSRSADAPAYKQGQNQL YNELNLGRREEYDVLDKRRGRDPEMGGKPRRKNPQ EGLYNELQKDKMAEAYSEIGMKGERRRGKGHDGLY QGLSTATKDTYDALHMQALPPRGSEETRELQSLAAA VVPSAQTLKITDFSFSDFELSDLETALCTIRMFTDLNL VQNFQMKHEVLCRWILSVKKNYRKNVAYHNWRHA FNTAQCMFAALKAGKIQNKLTDLEILALLIAALSHDL DHRGVNNSYIQRSEHPLAQLYCHSIMEHHHFDQCLM ILNSPGNQILSGLSIEEYKTTLKIIKQAILATDLALYIKR LGEFFELIRKNQFNLEDPHQKELFLAMLMTACDLSAI TKPWPIQQRIAELVATEFFDQGDRERKELNIEPTDLM NREKKNKIPSMQVGFIDAICLQLYEALTHVSEDCFPL LDGCRKNRQKWQALAEQQGSLDGATNFSLLKQAGD VEENPGPLSKGEEDNMAIIKEFMRFKVHMEGSVNGH EFEIEGEGEGRPYEGTQTAKLKVTKGGPLPFAWDILS PQFMYGSKAYVKHPADIPDYLKLSFPEGFKWERVM NFEDGGVVTVTQDSSLQDGEFIYKVKLRGTNFPSDG PVMQKKTMGWEASSERMYPEDGALKGEIKQRLKLK DGGHYDAEVKTTYKAKKPVQLPGAYNVNIKLDITSH NEDYTIVEQYERAEGRHSTGGMDELYK* | 8279 | 8293 |

TABLE 17B-continued

CD19 CARs constructs

| Description | Amino Acid Sequence | AA SEQ ID NO | NA SEQ ID NO |
|---|---|---|---|
| OT-CD19-101 (OT-001305) CD8a leader; HA Tag; CD19 scFV; CD8a-Tm; (4-1BB intracellular domain); CD3zeta signaling domain; Linker (GS); hPDE5 (Amino acid 535-860 of WT, R732L); Linker (GS), Spacer (LD); P2A linker; mCherry (M1L); stop | MALPVTALLLPLALLLHAARPYPYDVPDYADIQMTQ TTSSLSASLGDRVTISCRASQDISKYLNWYQQKPDGT VKLLIYHTSRLHSGVPSRFSGSGSGTDYSLTISNLEQE DIATYFCQQGNTLPYTFGGGTKLEITGGGGSGGGGS GGGGSEVKLQESGPGLVAPSQSLSVTCTVSGVSLPDY GVSWIRQPPRKGLEWLGVIWGSETTYYNSALKSRLTI IKDNSKSQVFLKMNSLQTDDTAIYYCAKHYYYGGSY AMDYWGQGTSVTVSSTTTPAPRPPTPAPTIASQPLSL RPEACRPAAGGAVHTRGLDFACDIYIWAPLAGTCGV LLLSLVITLYCKRGRKKLLYIFKQPFMRPVQTTQEED GCSCRFPEEEGGCELRVKFSRSADAPAYKQGQNQL YNELNLGRREEYDVLDKRRGRDPEMGGKPRRKNPQ EGLYNELQKDKMAEAYSEIGMKGERRRGKGHDGLY QGLSTATKDTYDALHMQALPPRGSEETRELQSLAAA VVPSAQTLKITDFSFSDFELSDLETALCTIRMFTDLNL VQNFQMKHEVLCRWILSVKKNYRKNVAYHNWRHA FNTAQCMFAALKAGKIQNKLTDLEILALLIAALSHDL DHRGVNNSYIQRSEHPLAQLYCHSIMEHHHFDQCLM ILNSPGNQILSGLSIEEYKTTLKIIKQAILATDLALYIKR LGEFFELIRKNQFNLEDPHQKELFLAMLMTACDLSAI TKPWPIQQRIAELVATEFFDQGDRERKELNIEPTDLM NREKKNKIPSMQVGFIDAICLQLYEALTHVSEDCFPL LDGCRKNRQKWQALAEQQGSLDGATNFSLLKQAGD VEENPGPLSKGEEDNMAIIKEFMRFKVHMEGSVNGH EFEIEGEGEGRPYEGTQTAKLKVTKGGPLPFAWDILS PQFMYGSKAYVKHPADIPDYLKLSFPEGFKWERVM NFEDGGVVTVTQDSSLQDGEFIYKVKLRGTNFPSDG PVMQKKTMGWEASSERMYPEDGALKGEIKQRLKLK DGGHYDAEVKTTYKAKKPVQLPGAYNVNIKLDITSH NEDYTIVEQYERAEGRHSTGGMDELYK* | 8280 | 8294 |
| OT-CD19-111 (OT-001454) CD8a leader; CD19 scFV; CD8a-Tm; (4-1BB intracellular domain); CD3zeta signaling domain; Linker (GS); hPDE5 (Amino acid 535-860 of WT, R732L); stop | MALPVTALLLPLALLLHAARPDIQMTQTTSSLSASLG DRVTISCRASQDISKYLNWYQQKPDGTVKLLIYHTSR LHSGVPSRFSGSGSGTDYSLTISNLEQEDIATYFCQQG NTLPYTFGGGTKLEITGGGGSGGGGSGGGGSEVKLQ ESGPGLVAPSQSLSVTCTVSGVSLPDYGVSWIRQPPR KGLEWLGVIWGSETTYYNSALKSRLTIIKDNSKSQVF LKMNSLQTDDTAIYYCAKHYYYGGSYAMDYWGQG TSVTVSSTTTPAPRPPTPAPTIASQPLSLRPEACRPAAG GAVHTRGLDFACDIYIWAPLAGTCGVLLLSLVITLYC KRGRKKLLYIFKQPFMRPVQTTQEEDGCSCRFPEEEE GGCELRVKFSRSADAPAYKQGQNQLYNELNLGRRE EYDVLDKRRGRDPEMGGKPRRKNPQEGLYNELQKD KMAEAYSEIGMKGERRRGKGHDGLYQGLSTATKDT YDALHMQALPPRGSEETRELQSLAAAVVPSAQTLKI TDFSFSDFELSDLETALCTIRMFTDLNLVQNFQMKHE VLCRWILSVKKNYRKNVAYHNWRHAFNTAQCMFA ALKAGKIQNKLTDLEILALLIAALSHDLDHRGVNNSY IQRSEHPLAQLYCHSIMEHHHFDQCLMILNSPGNQILS GLSIEEYKTTLKIIKQAILATDLALYIKRLGEFFELIRK NQFNLEDPHQKELFLAMLMTACDLSAITKPWPIQQRI AELVAIEFFDQGDRERKELNIEPTDLMNREKKNKIPS MQVGFIDAICLQLYEALTHVSEDCFPLLDGCRKNRQ KWQALAEQQ* | 8281 | 8295 |
| OT-CD19-130 (OT-001455) CD8a leader; CD19 scFV; CD8a-Tm; (4-1BB intracellular domain); CD3zeta signaling domain; Linker (GS); hPDE5 (Amino acid 535-860 of WT, H653A); stop | MALPVTALLLPLALLLHAARPDIQMTQTTSSLSASLG DRVTISCRASQDISKYLNWYQQKPDGTVKLLIYHTSR LHSGVPSRFSGSGSGTDYSLTISNLEQEDIATYFCQQG NTLPYTFGGGTKLEITGGGGSGGGGSGGGGSEVKLQ ESGPGLVAPSQSLSVTCTVSGVSLPDYGVSWIRQPPR KGLEWLGVIWGSETTYYNSALKSRLTIIKDNSKSQVF LKMNSLQTDDTAIYYCAKHYYYGGSYAMDYWGQG TSVTVSSTTTPAPRPPTPAPTIASQPLSLRPEACRPAAG GAVHTRGLDFACDIYIWAPLAGTCGVLLLSLVITLYC KRGRKKLLYIFKQPFMRPVQTTQEEDGCSCRFPEEEE GGCELRVKFSRSADAPAYKQGQNQLYNELNLGRRE EYDVLDKRRGRDPEMGGKPRRKNPQEGLYNELQKD KMAEAYSEIGMKGERRRGKGHDGLYQGLSTATKDT YDALHMQALPPRGSEETRELQSLAAAVVPSAQTLKI TDFSFSDFELSDLETALCTIRMFTDLNLVQNFQMKHE VLCRWILSVKKNYRKNVAYHNWRHAFNTAQCMFA ALKAGKIQNKLTDLEILALLIAALSADLDHRGVNNSY IQRSEHPLAQLYCHSIMEHHHFDQCLMILNSPGNQILS GLSIEEYKTTLKIIKQAILATDLALYIKRRGEFFELIRK | 8282 | 8296 |

TABLE 17B-continued

CD19 CARs constructs

| Description | Amino Acid Sequence | AA SEQ ID NO | NA SEQ ID NO |
|---|---|---|---|
| | NQFNLEDPHQKELFLAMLMTACDLSAITKPWPIQQRI AELVAIEFFDQGDRERKELNIEPTDLMNREKKNKIPS MQVGFIDAICLQLYEALTHVSEDCFPLLDGCRKNRQ KWQALAEQQ* | | |
| OT-CD19-131 (OT-001456) CD8a leader; CD19 scFV; CD8a-Tm; (4-1BB intracellular domain); CD3zeta signaling domain; Linker (GS); hPDE5 (Amino acid 535-860 of WT, H653A, R732L); stop | MALPVTALLLPLALLLHAARPDIQMTQTTSSLSASLG DRVTISCRASQDISKYLNWYQQKPDGTVKLLIYHTSR LHSGVPSRFSGSGSGTDYSLTISNLEQEDIATYFCQQG NTLPYTFGGGTKLEITGGGGSGGGGSGGGGSEVKLQ ESGPGLVAPSQSLSVTCTVSGVSLPDYGVSWIRQPPR KGLEWLGVIWGSETTYYNSALKSRLTIIKDNSKSQVF LKMNSLQTDDTAIYYCAKHYYYGGSYAMDYWGQG TSVTVSSTTTPAPRPPTPAPTIASQPLSLRPEACRPAAG GAVHTRGLDFACDIYIWAPLAGTCGVLLLSLVITLYC KRGRKKLLYIFKQPFMRPVQTTQEEDGCSCRFPEEEE GGCELRVKFSRSADAPAYKQGQNQLYNELNLGRRE EYDVLDKRRGRDPEMGGKPRRKNPQEGLYNELQKD KMAEAYSEIGMKGERRRGKGHDGLYQGLSTATKDT YDALHMQALPPRGSEETRELQSLAAAVVPSAQTLKI TDFSFSDFELSDLETALCTIRMFTDLNLVQNFQMKHE VLCRWILSVKKNYRKNVAYHNWRHAFNTAQCMFA ALKAGKIQNKLTDLEILALLIAALSADLDHRGVNNSY IQRSEHPLAQLYCHSIMEHHHFDQCLMILNSPGNQILS GLSIEEYKTTLKIIKQAILATDLALYIKRLGEFFELIRK NQFNLEDPHQKELFLAMLMTACDLSAITKPWPIQQRI AELVAIEFFDQGDRERKELNIEPTDLMNREKKNKIPS MQVGFIDAICLQLYEALTHVSEDCFPLLDGCRKNRQ KWQALAEQQ* | 8283 | 8297 |
| OT-CD19-132 (OT-001457) CD8a leader; CD19 scFV; CD8a-Tm; (4-1BB intracellular domain); CD3zeta signaling domain; Linker (GS); hPDE5 (Amino acid 535-860 of WT, R732L, D764A); stop | MALPVTALLLPLALLLHAARPDIQMTQTTSSLSASLG DRVTISCRASQDISKYLNWYQQKPDGTVKLLIYHTSR LHSGVPSRFSGSGSGTDYSLTISNLEQEDIATYFCQQG NTLPYTFGGGTKLEITGGGGSGGGGSGGGGSEVKLQ ESGPGLVAPSQSLSVTCTVSGVSLPDYGVSWIRQPPR KGLEWLGVIWGSETTYYNSALKSRLTIIKDNSKSQVF LKMNSLQTDDTAIYYCAKHYYYGGSYAMDYWGQG TSVTVSSTTTPAPRPPTPAPTIASQPLSLRPEACRPAAG GAVHTRGLDFACDIYIWAPLAGTCGVLLLSLVITLYC KRGRKKLLYIFKQPFMRPVQTTQEEDGCSCRFPEEEE GGCELRVKFSRSADAPAYKQGQNQLYNELNLGRRE EYDVLDKRRGRDPEMGGKPRRKNPQEGLYNELQKD KMAEAYSEIGMKGERRRGKGHDGLYQGLSTATKDT YDALHMQALPPRGSEETRELQSLAAAVVPSAQTLKI TDFSFSDFELSDLETALCTIRMFTDLNLVQNFQMKHE VLCRWILSVKKNYRKNVAYHNWRHAFNTAQCMFA ALKAGKIQNKLTDLEILALLIAALSHDLDHRGVNNSY IQRSEHPLAQLYCHSIMEHHHFDQCLMILNSPGNQILS GLSIEEYKTTLKIIKQAILATDLALYIKRLGEFFELIRK NQFNLEDPHQKELFLAMLMTACALSAITKPWPIQQRI AELVAIEFFDQGDRERKELNIEPTDLMNREKKNKIPS MQVGFIDAICLQLYEALTHVSEDCFPLLDGCRKNRQ KWQALAEQQ* | 8284 | 8298 |

Tandem CAR (TanCAR)

In some embodiments, the CAR of the present invention may be a tandem chimeric antigen receptor (TanCAR) which is able to target two, three, four, or more tumor specific antigens. In some aspects, the CAR is a bispecific TanCAR including two targeting domains which recognize two different TSAs on tumor cells. The bispecific CAR may be further defined as comprising an extracellular region comprising a targeting domain (e.g., an antigen recognition domain) specific for a first tumor antigen and a targeting domain (e.g., an antigen recognition domain) specific for a second tumor antigen. In other aspects, the CAR is a multispecific TanCAR that includes three or more targeting domains configured in a tandem arrangement. The space between the targeting domains in the TanCAR may be between about 5 and about 30 amino acids in length, for example, 6, 7, 8, 9, 10, 11, 12, 13, 14, 15, 16, 17, 18, 19, 20, 21, 22, 23, 24, 25, 26, 27, 28, 29 and 30 amino acids.

Split CAR

In some embodiments, the components including the targeting moiety, transmembrane domain and intracellular signaling domains of the present invention may be split into two or more parts such that it is dependent on multiple inputs that promote assembly of the intact functional receptor. In one embodiment, the split synthetic CAR system can be constructed in which the assembly of an activated CAR receptor is dependent on the binding of a ligand to the SRE (e.g. a small molecule) and a specific antigen to the targeting moiety. As a non-limiting example, the split CAR consists of two parts that assemble in a small molecule-dependent manner; one part of the receptor features an extracellular antigen binding domain (e.g. scFv) and the other part has the intracellular signaling domains, such as the CD3ζ intracellular domain.

In other aspects, the split parts of the CAR system can be further modified to increase signal. In one example, the second part of cytoplasmic fragment may be anchored to the plasma membrane by incorporating a transmembrane domain (e.g., CD8a transmembrane domain) to the construct. An additional extracellular domain may also be added to the second part of the CAR system, for instance an extracellular domain that mediates homo-dimerization. These modifications may increase receptor output activity, i.e., T cell activation.

In some aspects, the two parts of the split CAR system contain heterodimerization domains that conditionally interact upon binding of a heterodimerizing small molecule. As such, the receptor components are assembled in the presence of the small molecule, to form an intact system which can then be activated by antigen engagement. Any known heterodimerizing components can be incorporated into a split CAR system. Other small molecule dependent heterodimerization domains may also be used, including, but not limited to, gibberellin-induced dimerization system (GID1-GAI), trimethoprim-SLF induced ecDHFR and FKBP dimerization (Czlapinski et al., *J Am Chem Soc.,* 2008, 130(40): 13186-13187) and ABA (abscisic acid) induced dimerization of PP2C and PYL domains (Cutler et al., *Annu Rev Plant Biol.* 2010, 61: 651-679). The dual regulation using inducible assembly (e.g., ligand dependent dimerization) and degradation (e.g., destabilizing domain induced CAR degradation) of the split CAR system may provide more flexibility to control the activity of the CAR modified T cells.

Switchable CAR

In some embodiments, the CAR of the invention may be a switchable CAR. Juilerat et al (Juilerat et al., *Sci. Rep.,* 2016, 6: 18950; the contents of which are incorporated herein by reference in their entirety) recently reported controllable CARs that can be transiently switched on in response to a stimulus (e.g. a small molecule). In this CAR design, a system is directly integrated in the hinge domain that separate the scFv domain from the cell membrane domain in the CAR. Such system is possible to split or combine different key functions of a CAR such as activation and co-stimulation within different chains of a receptor complex, mimicking the complexity of the TCR native architecture. This integrated system can switch the scFv and antigen interaction between on/off states controlled by the absence/presence of the stimulus.

Reversible CAR

In other embodiments, the CAR of the invention may be a reversible CAR system. In this CAR architecture, a LID domain (ligand-induced degradation) is incorporated into the CAR system. The CAR can be temporarily down-regulated by adding a ligand of the LID domain. The combination of LID and DD mediated regulation provides tunable control of continuingly activated CAR T cells, thereby reducing CAR mediated tissue toxicity.

Inhibitory CAR (iCAR)

In some embodiments, payloads of the present invention may be inhibitory CARs. Inhibitory CAR (iCAR) refers to a bispecific CAR design wherein a negative signal is used to enhance the tumor specificity and limit normal tissue toxicity. This design incorporates a second CAR having a surface antigen recognition domain combined with an inhibitory signal domain to limit T cell responsiveness even with concurrent engagement of an activating receptor. This antigen recognition domain is directed towards a normal tissue specific antigen such that the T cell can be activated in the presence of first target protein, but if the second protein that binds to the iCAR is present, the T cell activation is inhibited.

As a non-limiting example, iCARs against Prostate specific membrane antigen (PMSA) based on CTLA4 and PD1 inhibitory domains demonstrated the ability to selectively limit cytokine secretion, cytotoxicity and proliferation induced by T cell activation (Fedorov V. D, et al., 2013, *Sci Transl Med,* 11; 5(215):215ra172; the contents of which are incorporated herein in their entirety).

Chimeric Switch Receptor

In some embodiments, payloads of the invention may be chimeric switch receptors which can switch a negative signal to a positive signal. As used herein, the term "chimeric switch receptor" refers to a fusion protein comprising a first extracellular domain and a second transmembrane and intracellular domain, wherein the first domain includes a negative signal region and the second domain includes a positive intracellular signaling region. In some aspects, the fusion protein is a chimeric switch receptor that contains the extracellular domain of an inhibitory receptor on T cell fused to the transmembrane and cytoplasmic domain of a co-stimulatory receptor. This chimeric switch receptor may convert a T cell inhibitory signal into a T cell stimulatory signal.

As a non-limiting example, the chimeric switch receptor may comprise the extracellular domain of PD-1 fused to the transmembrane and cytoplasmic domain of CD28 as taught by Liu et al. (Liu et al., *Cancer Res.,* 2016, 76(6): 1578-1590; the contents of which are incorporated by reference in their entirety). In some aspects, extracellular domains of other inhibitory receptors such as CTLA-4, LAG-3, TIM-3, KIRs and BTLA may also be fused to the transmembrane and cytoplasmic domain derived from costimulatory receptors such as CD28, 4-1BB, CD27, OX40, CD40, GTIR and ICOS. In the context of the present invention, the SRE domain (e.g., DD) may be inserted at the N- or C-terminus of the chimeric switch receptor.

In some embodiments, chimeric switch receptors of the present invention may include recombinant receptors comprising the extracellular cytokine-binding domain of an inhibitory cytokine receptor (e.g., IL13 receptor α (IL13Rα1), IL10R, and IL4Rα) fused to an intracellular signaling domain of a stimulatory cytokine receptor such as IL2R (IL2Rα, IL2Rβ and IL2Rgamma) and IL7Rα. One example of such chimeric cytokine receptor is a recombinant receptor containing the cytokine-binding extracellular domain of IL4Rα linked to the intracellular signaling domain of IL7Rα (see, US patent publication NO: 2014/0050709; the contents of which are incorporated herein by reference in their entirety).

In one embodiment, the chimeric switch receptor of the present invention may be a chimeric TGFβ receptor. The chimeric TGFβ receptor may comprise an extracellular domain derived from a TGFβ receptor such as TGFβ receptor 1, TGFβ receptor 2, TGFβ receptor 3, or any other TGFβ receptor or variant thereof; and a non-TGFβ receptor intracellular domain. The non-TGFβ receptor intracellular domain may be the intracellular domain or fragment thereof derived from TLR1, TLR2, TLR3, TLR4, TLR5, TLR6, TLR7, TLR8, TLR9, TLR10, CD28, 4-1BB (CD137), OX40 (CD134), CD3zeta, CD40, CD27, or a combination thereof. One example of such chimeric TGFβ receptor is discussed in US patent publication NO.: US2016/0075755; the contents of which are incorporated herein by reference in their entirety.

In some embodiments, payloads of the present invention may be bipartite fusion receptors. In one aspect, the bipartite fusion receptor may comprise an antigen-binding domain that binds to a tumor antigen and an activation domain that binds to one or more cell surface molecules. In some aspects, the antigen binding domain of a bipartite receptor is a scFv antibody. In other aspects, the activation domain that binds to a T cell surface stimulatory molecule may be selected from CD3, CD27, CD 28, CD40, OX40(CD134) and 4-1BB (CD137), or a NK cell surface stimulatory molecule selected from CD16, NKG2D and NKp30. The activation domain may also be a scFv specific to a stimulatory molecule on the surface of immune cells (e.g., T cells and NK cells). Immune cells can be genetically modified to express a bipartite molecule comprising at least one antigen binding domain and an activation domain. The antigen binding domain binds to one or more molecules present on target cells such as cancer cells. Immune cells that express the molecule recognized by the activation domain will be activated and attack the recognized cancer cells. As a non-limiting example, a bipartite molecule may be an engager molecule comprising an antigen recognition scFv specific to CD19 or EphA2, as described in US patent publication NO: US2016/0015749; the contents of which are incorporated by reference herein in their entirety.

Activation-Conditional CAR

In some embodiments, payloads of the invention may be an activation-conditional chimeric antigen receptor, which is only expressed in an activated immune cell. The expression of the CAR may be coupled to activation conditional control region which refers to one or more nucleic acid sequences that induce the transcription and/or expression of a sequence e.g. a CAR under its control. Such activation conditional control regions may be promoters of genes that are upregulated during the activation of the immune effector cell e.g. IL2 promoter or NFAT binding sites. In some embodiments, activation of the immune cell may be achieved by a constitutively expressed CAR (International Publication No: WO 2016126608; the contents of which are incorporated herein by reference in their entirety).

CAR Targeting to Tumor Cells with Specific Proteoglycan Markers

In some embodiments, payloads of the present invention may be a CAR that targets specific types of cancer cells. Human cancer cells and metastasis may express unique and otherwise abnormal proteoglycans, such as polysaccharide chains (e.g., chondroitin sulfate (CS), dermatan sulfate (DS or CSB), heparan sulfate (HS) and heparin). Accordingly, the CAR may be fused with a binding moiety that recognizes cancer associated proteoglycans. In one example, a CAR may be fused with VAR2CSA polypeptide (VAR2-CAR) that binds with high affinity to a specific type of chondroitin sulfate A (CSA) attached to proteoglycans. The extracellular ScFv portion of the CAR may be substituted with VAR2CSA variants comprising at least the minimal CSA binding domain, generating CARs specific to chondroitin sulfate A (CSA) modifications. Alternatively, the CAR may be fused with a split-protein binding system to generate a spy-CAR, in which the scFv portion of the CAR is substituted with one portion of a split-protein binding system such as SpyTag and Spy-catcher and the cancer-recognition molecules (e.g. scFv and or VAR2-CSA) are attached to the CAR through the split-protein binding system (See, e.g., PCT publication No.: WO2016/135291; the contents of which are incorporated by reference in their entirety.)

SUPRA CAR

In some embodiments, the payload of the present invention may be a Split Universal Programmable (SUPRA) CAR. A SUPRA CAR may be a two-component receptor system comprising of a universal receptor (zip CAR) expressed on T cells and a tumor-targeting scFv adaptor. The zip CAR universal receptor may be generated by the fusion of intracellular signaling domains and a leucine zipper as the extracellular domain. The tumor-targeting scFv adaptor molecule or zipFv, may be generated by the fusion of a cognate leucine zipper and an scFv. The scFv of the zipFv may bind to a tumor antigen, and the leucine zipper may bind and activate the zip CAR on the T cells. Unlike the conventional fixed CAR design, the SUPRA CAR modular design allows targeting of multiple antigens without further genetic manipulations of the immune cells. Any of the CAR designs disclosed by Cho et al., 2018, Cell 173, 1-13, may be useful in the present invention (the contents of which are incorporated by reference in their entirety).

6. Cytokines, Chemokines and Other Soluble Factors

In accordance with the present invention, payloads of the present invention may be cytokines, chemokines, growth factors, and soluble proteins produced by immune cells, cancer cells and other cell types, which act as chemical communicators between cells and tissues within the body. These proteins mediate a wide range of physiological functions, from effects on cell growth, differentiation, migration and survival, to a number of effector activities. For example, activated T cells produce a variety of cytokines for cytotoxic function to eliminate tumor cells.

In some embodiments, payloads of the present invention may be cytokines, and fragments, variants, analogs and derivatives thereof, including but not limited to interleukins, tumor necrosis factors (TNFs), interferons (IFNs), TGF beta and chemokines. In some embodiments, payloads of the present invention may be cytokines that stimulate immune responses. In other embodiments, payloads of the invention may be antagonists of cytokines that negatively impact anti-cancer immune responses.

In some embodiments, payloads of the present invention may be cytokine receptors, recombinant receptors, variants, analogs and derivatives thereof; or signal components of cytokines.

In some embodiments, cytokines of the present invention may be utilized to improve expansion, survival, persistence, and potency of immune cells such as CD8+$T_{EM}$, natural killer cells and tumor infiltrating lymphocytes (TIL) cells used for immunotherapy. In other embodiments, T cells engineered with two or more DD regulated cytokines are utilized to provide kinetic control of T cell activation and tumor microenvironment remodeling. In one aspect, the present invention provides biocircuits and compositions to minimize toxicity related to cytokine therapy. Despite its success in mitigating tumor burden, systemic cytokine therapy often results in the development of severe dose limiting side effects. Two factors contribute to the observed toxicity (a) Pleiotropism, wherein cytokines affect different cells types and sometimes produce opposing effects on the same cells depending on the context (b) Cytokines have short serum half-life and thus need to be administered at high doses to achieve therapeutic effects, which exacerbates the pleiotropic effects. In one aspect, cytokines of the present invention may be utilized to modulate cytokine expression in the event of adverse effects. In some embodiments, cytokines of the present invention may be designed to have prolonged life span or enhanced specificity to minimize toxicity.

In some embodiments, the payload of the present invention may be an interleukin (IL) cytokine. Interleukins (ILs) are a class of glycoproteins produced by leukocytes for regulating immune responses. As used herein, the term "interleukin (IL)" refers to an interleukin polypeptide from any species or source and includes the full-length protein as well as fragments or portions of the protein. In some aspects, the interleukin payload is selected from IL1, IL1alpha (also called hematopoietin-1), IL1beta (catabolin), IL1 delta, IL1epsilon, IL1eta, IL1 zeta, interleukin-1 family member 1 to 11 (IL1F1 to IL1F11), interleukin-1 homolog 1 to 4 (IL1H1 to IL1H4), IL1 related protein 1 to 3 (IL1RP1 to IL1RP3), IL2, IL3, IL4, IL5, IL6, IL7, IL8, IL9, IL10, IL10C, IL10D, IL11, IL11a, IL11b, IL12, IL13, IL14, IL15, IL16, IL17, IL17A, 117B, IL17C, IL17E, IL17F, IL18, IL19, IL20, IL20 like (IL20L), Il21, IL22, IL23, IL23A, IL23-p19, IL23-p40, IL24, Il25, IL26, IL27, IL28A, IL28B, IL29, IL30, IL31, IL32, IL33, IL34, IL35, IL36 alpha, IL36 beta, IL36 gamma, IL36RN, IL37, IL37a, IL37b, IL37c, IL37d, IL37e and IL38. In other aspects, the payload of the present invention may be an interleukin receptor selected from CD121a, CDw121b, IL2Rα/CD25, IL2Rβ/CD122, IL2Rγ/CD132, CDw131, CD124, CD131, CDw125, CD126, CD130, CD127, CDw210, IL8RA, IL11Rα, CD212, CD213α1, CD213α2, IL14R, IL15Rα, CDw217, IL18Rα, IL18Rβ, IL20Rα, and IL20R3.

In certain embodiments, a cytokine may be a type I interferons (IFN) including IFN alpha subtypes (IFN α1, IFN α1b, IFN α1c), IFN beta, IFN delta subtypes (IFN delta 1, IFN delta 2, IFN delta 8), IFN gamma, IFN kappa, and IFN epsilon, IFN lambda, IFN omega, IFN tau and IFN zeta. In certain embodiments, a cytokine may be a member of tumor necrosis factor (TNF) superfamily, including TNF-alpha, TNF-beta (also known as lymphotoxin-alpha (LT-α)), lymphotoxin-beta (LT-β), CD40L(CD154), CD27L (CD70), CD30L(CD153), FASL(CD178), 4-1BBL (CD137L), OX40L, TRAIL (TNF-related apoptosis inducing ligand), APRIL (a proliferation-inducing ligand), TWEAK, TRANCE, TALL-1, GITRL, LIGHT and TNFSF1 to TNFSF20 (TNF ligand superfamily member 1 to 20).

In one embodiment, the payload of the invention may comprise IL2 (SEQ ID NO. 8299, encoded by SEQ ID NO. 8300 and 8301). In one aspect, the effector module of the invention may be a DD-IL2 fusion polypeptide.

In some aspects of the invention, an IL2 mutein may be used as a payload. As used herein, the term "mutein" is a construct, molecule or sequence of a mutation, change or alteration in a protein and hence is also known as a mutant, e.g., a protein mutant, mutein. Consequently, an "IL2 mutein" is an IL2 mutant. In some embodiments an IL2 mutein is a variant of wild type IL2 protein, where the wildtype IL2 consists of the amino acid sequence of SEQ ID NO. 8299. In some aspects, it refers to an IL2 variant which binds to and activates only cells expressing IL2Rαβγ, but does not significantly bind to or activate cell expressing only IL2Rβγ. In some examples, an IL2 mutein may be an IL2 protein in which residues of IL2 responsible for binding to either IL2Rβ or IL2Rγ are substituted and abolish their interaction. In other examples, an IL2 mutein may be an IL2 protein comprising mutations conferring high affinity for IL2Rα. An IL2 mutein may be an IL2 selective agonist (IL2$_{SA}$) which can preferentially activate the high affinity IL2 receptor (i.e., IL2Rαβγ) which is necessary to selectively activate T cells with respect to NK cells. In some embodiments, the IL2 mutein may be IL2 protein which preferentially binds to the lower affinity IL2Rβγ but with reduced affinity to CD25.

In some embodiments, IL2 muteins may be used to preferentially expand or stimulate Treg cells. As used herein "preferentially expand or stimulate Treg cells" means the IL2 muteins promote the proliferation, survival, activation and/or function of T regulatory cells.

Exemplary IL2 muteins may include, but are not limited to, N88R substitution (Shanafelt et al., *Nature Biotech.*, 2000, 18:1197-1202), an IL2 with a V91K substitution (e.g., US Patent publication NO. US20140286898); V91K substitution, C125A substitution, an IL2 with three mutations: V69A, N71R, Q74P; an IL2 mutein with high affinity for IL2Rα (N29S, Y31H, K35R, T37A, K48E, V69A, N71R, Q74P); an IL2 mutein with high affinity for IL2Rα and reduced signaling activity (N29S, Y31H, K35R, T37A, K48E, V69A, N71R, Q74P, N88D), and D20H, D201, N88G, N88I, N88R, and Q126L substitutions as described in PCT application NO. 1999060128; the contents of each of which are incorporated herein by reference in their entirety. In other aspects, IL2 muteins may include those described in U.S. Pat. Nos. 4,518,584; 5,116,943; 5,206,344; 6,955,807; 7,105,653; 7,371,371; 7,803,361; 8,124,066; 8,349,311; 8,759,486; and 9,206,243; PCT patent publication NOs: WO2005086751 and WO2012088446; EP Pat. NOs: EP0234599 and EP0200280 and Sim, G. C. et al. (2016) Cancer Immunol Res; 4(11):983-994; the contents of each of which are incorporated herein by reference in their entirety.

In some aspects, the IL2 mutein may be fused to a polypeptide that extends the serum half-life of the IL2 mutein, such as an IgG Fc fragment. Preferred Fc regions are derived from human IgG, which includes IgG1, IgG2, IgG3, and IgG4. In other aspects, the payload of the invention may be an IL2 fusion protein comparing a second functional polypeptide. In a non-limiting example, an IL2 fusion protein may comprise an IL2 or IL2 mutein polypeptide fused with a pro-apoptotic Bcl-2 family polypeptide (such as Bad, Bik/Nbk, Bid, Bim/Bod, Hrk, Bak or Bax); such fusion protein may be capable of inhibiting cell survival, inhibiting cell proliferation, or enhancing cell death or apoptosis of a target cell expressing an IL2 receptor. Alternatively, an IL2 or IL2 mutein polypeptide may be fused with an anti-apoptotic Bcl-2 family polypeptide (such as Bcl-x$_L$, Bcl-w or Bcl-2). The fusion protein may be capable of enhancing cell survival, enhancing cell proliferation, or inhibiting cell death or apoptosis of a target cell expressing an IL2 receptor. See, e.g., US patent publication NO.: US2016/0229901.

In addition, the IL2 fusion protein may be a IL2-GMCSF fusion protein which can promote cell-cell interaction; therefore, enhances anti-cancer immune responses (Wen et al., *J. Translational Med.*, 2016, 14: 41).

In one embodiment, the payload of the invention may comprise IL12. IL12 is a heterodimeric protein of two subunits (p35, p40) that is secreted by antigen presenting cells, such as macrophages and dendritic cells. IL12 is type 1 cytokine that acts on natural killer (NK) cells, macrophages, CD8$^+$ Cytotoxic T cells, and CD4$^+$ T helper cells through STAT4 pathway to induce IFN γ production in these effector immune cells (reviewed by Trinchieri G, *Nat Rev Immunol.* 2003; 3(2): 133-146). IL12 can promote the cytotoxic activity of NK cells and CD8$^+$ T cells, therefore has anti-tumor function. Intravenous injection of recombinant IL12 exhibited modest clinical efficacy in a handful of patients with advanced melanoma and renal cell carcinoma (Gollob et al., *Clin. Cancer Res.* 2000; 6(5):1678-1692). IL12 has been used as an adjuvant to enhance cytotoxic immunity using a melanoma antigen vaccine, or using peptide pulsed peripheral blood mononuclear cells; and to promote NK cell activity in breast cancer with trastuzumab treatment. Local delivery of IL12 to the tumor microenvironment promotes tumor regression in several tumor models. These studies all indicate that locally increased IL12 level can promote anti-tumor immunity. One major obstacle of systemic or local administration of recombinant IL12 protein, or through oncolytic viral vectors is the severe side effects when IL12 is presented at high level. Developing a system that tightly controls IL12 level may provide a safe use of IL12 in cancer treatment.

In one aspect, the effector module of the invention may be a DD-IL12 fusion polypeptide. This regulatable DD-IL12 fusion polypeptide may be directly used as an immunotherapeutic agent or be transduced into an immune effector cell (T cells and TIL cells) to generate modified T cells with greater in vivo expansion and survival capabilities for adoptive cell transfer. The need for harsh preconditioning regimens in current adoptive cell therapies may be minimized using regulated IL12; DD-IL12 may be utilized to modify tumor microenvironment and increase persistence in solid tumors that are currently refractory to tumor antigen targeted therapy. In some embodiments, CAR expressing T cells may be armored with DD regulated IL12 to relieve immunosuppression without systemic toxicity.

In some embodiments, the IL12 may be a Flexi IL12, wherein both p35 and p40 subunits, are encoded by a single cDNA that produces a single chain polypeptide. In one embodiment, the IL12 may comprise p40 subunit, which includes amino acids 23-328 of wildtype IL12B and comprise the amino acid sequence of SEQ ID NO. 8302 (encoded by SEQ ID NO. 8303-8312) and a p35 subunit, which includes amino acids 57-253 of wildtype IL12A and comprise the amino acid sequence of SEQ ID NO. 8313 (encoded by SEQ ID NO. 8314-8323). Any portion of IL12 that retains one or more functions of full length or mature IL12 may be useful in the present invention.

In some embodiments, DD regulated IL12 compositions of the invention may be utilized to minimize the cytotoxicity associated with systemic L12 administration. Treatment with IL12 has been associated with systemic flu-like symptoms (fever, chills, fatigue, arthromyalgia, headache), toxic effects on the bone marrow, and liver. Hematologic toxicity observed most commonly included neutropenia and thrombocytopenia; hepatic dysfunction manifested in transient (dose dependent) increase in transaminases, hyperbilirubinemia and hypoalbuminemia. In some instances, toxicity is also associated with inflammation of the mucus membranes (oral mucositis, stomatitis or colitis). These toxic effects of IL12 were related to the secondary production of IFNγ, TNF alpha, and chemokines such as IP 10, and MIG. In certain aspects of the invention, DD regulated IL12 may be utilized to prevent the toxic effects associated with elevated production of secondary messengers. In some embodiments, DD regulated Flexi-IL12 constructs may be used to improve the efficacy of the CARs, especially in solid tumor settings, by providing a controlled local signal for tumor microenvironment remodeling and epitope spreading. DD regulation also provides rapid, dose dependent, and local production of Flexi IL12.

The format of the IL12 constructs utilized as payload of the present invention may be optimized. In one embodiment, the payload of the invention may be a bicistronic IL12 containing p40 and p35 subunits separated by an internal ribosome entry site or a cleavage site such as P2A or Furin to allow independent expression of both subunits from a single vector. This results in a configuration of secreted IL12 that is more akin to the naturally occurring IL12 than the flexi IL12 construct, the payload of the invention may be the p40 subunit of the IL12. DD regulated p40 may be co-expressed with constitutive p35 construct to generate "regulatable IL12" expression. Alternatively, the DD regulated p40 may heterodimerize with the endogenous p35. p40 has been shown to stabilize p35 expression and stimulate the export of p35 (Jalah R, et al. (2013). Journal of Biol. Chem. 288, 6763-6776 (the contents of which are incorporated by reference in its entirety).

In some embodiments, modified forms of IL12 may be utilized as the payload. These modified forms of IL12 may be engineered to have shortened half-life in vivo compared to the non-modified form of especially when used in combination with tunable systems described herein.

Human flexi IL12 has a reported half-life of 5-19 hours which, when administered as a therapeutic compound, can result in systemic cytotoxicity (Car et al. (1999) The Toxicology of Interleukin-12: A Review" Toxicologic Path. 27 A, 58-63; Robertson et al. (1999) "Immunological Effects of Interleukin 12 Administered by Bolus Intravenous Injection to Patients with Cancer" Clin. Cancer Res. 5:9-16; Atkins et al. (1997) "Phase I Evaluation of Intravenous Recombinant Human Interleukin 12 in Patients with Advance Malignancies" Clin. Cancer Res. 3:409-417). The ligand inducible control of IL12 can regulate production in a dose dependent fashion, the time from cessation of ligand dosing to cessation of protein synthesis and IL12 clearance may be insufficient to prevent toxic accumulation of IL12 in plasma.

In one embodiment, the modified form of IL12 utilized as the payload may be a Topo-sc IL12 which have the configuration as follows from N to C terminus (i) a first IL12 p40 domain (p40N), (ii) an optional first peptide linker, (iii) an IL12 p35 domain, (iv) an optional second peptide linker, and (v) a second IL12 p40 domain (p40C). In one embodiment, modified topo sc IL12 polypeptides exhibit increased susceptibility to proteolysis. Topo-sc IL12 is described in International Patent Publication No. WO2016048903; the contents of which are incorporated herein by reference in its entirety.

IL12 polypeptide may also be modified (e.g. genetically, synthetically, or recombinantly engineered) to increase susceptibility to proteinases to reduce the biologically active half-life of the IL12 complex, compared to a corresponding IL12 lacking proteinases susceptibility. Proteinase susceptible forms of IL12 are described in International Patent Publication No. WO2017062953; the contents of which are incorporated by reference in its entirety.

IL12 systemic toxicity may also be limited or tightly controlled via mechanisms involving tethering IL12 to the cell surface to limit its therapeutic efficacy to the tumor site. Membrane tethered IL12 forms have been described previously using Glycosyl phosphatidylinositol (GPI) signal peptide or using CD80 transmembrane domain (Nagarajan S, et al. (2011) J Biomed Mater Res A. 99(3):410-7; Bozeman E N, et al. (2013) Vaccine. 7; 31(20):2449-56; Wen-Yu Pan et al. (2012), Mol. Ther. 20:5, 927-937; the contents of each of which are incorporated by reference in their entirety). In some embodiments, transmembrane domains may be selected from any of those described in Table 13, Table 14, and Table 15.

In some embodiments, the IL12 levels secreted by the immune cells of the invention may approximately be comparable to the IL12 levels secreted by human myeloid dendritic cells (mDC1), when activated with TLR agonists.

In one embodiment, the TLR agonist may be the combination of lipopolysaccharide administered with R848.

In some embodiments, the IFN gamma secreted by IL12 induced activation of the immune cells is at least 5-fold greater in the presence of ligand, compared to the levels in the absence of ligand.

In some embodiments, regulation of IL12 provides the necessary safety switch. In some embodiments, IL-12 secretion recruit and/or activates effector cells in the tumor microenvironment. In some embodiments, the IL12 regulation provides a benefit to CAR T function without causing toxicity.

In one embodiment, the payload of the invention may comprise IL15. Interleukin 15 is a potent immune stimulatory cytokine and an essential survival factor for T cells, and Natural Killer cells. Preclinical studies comparing IL2 and IL15, have shown than IL15 is associated with less toxicity than IL2. In some embodiments, the effector module of the invention may be a DD-IL15 fusion polypeptide. IL15 polypeptide may also be modified to increase its binding affinity for the IL15 receptor. For example, the asparagine may be replaced by aspartic acid at position 72 of IL15 (SEQ ID NO. 2 of US patent publication US20140134128A1; the contents of which are incorporated by reference in their entirety). In some aspects, the IL15 comprises amino acid sequence of SEQ ID NO. 8234 (encoded by SEQ ID NO. 8236), which include amino acids 49-162 of wildtype IL15. In some embodiments the IL15 sequence may include a stop codon and may be encoded by the nucleotide sequence of SEQ ID NO.8235, and 8237-8238.

A unique feature of IL15 mediated activation is the mechanism of trans-presentation in which IL15 is presented as a complex with the alpha subunit of IL15 receptor (IL15Ra) that binds to and activates membrane bound IL15 beta/gamma receptor, either on the same cell or a different cell. The IL15/IL15Ra complex is more effective in activating IL15 signaling, than IL15 by itself. Thus, in some embodiments, the effector module of the invention may include a DD-IL15/IL15Ra fusion polypeptide. In one embodiment, the payload may be IL15/IL15Ra fusion polypeptide described in US Patent Publication NO.: US20160158285A1 (the contents of which are incorporated herein by reference in their entirety). The IL15 receptor alpha comprises an extracellular domain called the sushi domain which contains most of the structural elements necessary for binding to IL15. Thus, in some embodiments, payload may be the IL15/IL15Ra sushi domain fusion polypeptide described in US Patent Publication NO.: US20090238791A1 (the contents of which are incorporated herein by reference in their entirety).

Regulated IL15/IL15Ra may be used to promote expansion, survival and potency of $CD8T_{EM}$ cell populations without impacting regulatory T cells, NK cells and TIL cells. In one embodiment, DD-IL15/IL15Ra may be utilized to enhance CD19 directed T cell therapies in B cell leukemia and lymphomas. In one aspect, IL15/IL15Ra may be used as payload of the invention to reduce the need for pre-conditioning regimens in current CAR-T treatment paradigms.

The effector modules containing DD-IL15, DD-IL15/IL15Ra and/or DD-IL15/IL15Ra sushi domain may be designed to be secreted (using e.g. IL2 signal sequence) or membrane bound (using e.g. IgE or CD8a signal sequence).

In some embodiments, the IFN gamma secreted by IL15 induced activation of the immune cells is at least 10-fold greater in the presence of ligand, compared to the levels in the absence of ligand.

In some embodiments, regulation of IL15-IL15Ra fusion proteins provides a safety switch as compared to constitutively expressed IL15-IL15Rα. In some embodiments, IL15-IL15Ra leads to better expansion, and/or persistence of CAR T cells.

In some aspects, the DD-IL115/IL15Ra comprises the amino acid sequences provided in Table 18. In some embodiments, the linker utilized in Table 18 may be SG linker. In Table 18, asterisk indicates the translation of the stop codon. In some embodiments, the DDs described in Table 18 may contain an additional stop codon. As used herein the wildtype (WT) of IL15 refers to Uniprot ID: P40933 and wildtype (WT) of IL15Ra refers to UniProt ID: Q13261. Table 18 also provides alternate aliases for a given construct ID. These aliases are identified by the prefix OT.

TABLE 18

DD-IL15-IL15Ra construct sequences

| Description/<br>Construct ID | Amino Acid Sequence | AA<br>SEQ<br>ID NO | NA<br>SEQ<br>ID NO |
|---|---|---|---|
| IL15 (49-162 of WT) | NWVNVISDLKKIEDLIQSMHIDATLYIESDVHPSCKVTA<br>MKCFLLELQVISLESGDASIHDTVENLIILANNSLSSNGNV<br>TESGCKECEELEEKNIKEFLQSFVHIVQMFINTS | 8324 | 8326;<br>8344 |
| IL15Ra (31-267 of WT) | ITCPPPMSVEHADIWVKSYSLYSRERYICNSGFKRKAGTS<br>SLTECVLNKATNVAHWTTPSLKCIRDPALVHQRPAPPST<br>VTTAGVTPQPESLPSGKEPAASSPSSNNTAATTAAIVPGS<br>QLMPSKSPSTGTTEISSHESSHGTPSQTTAKNWELTASAS<br>HQPPGVYPQGHSDTTVAISTSTVLLCGLSAVSLLACYLKS<br>RQTPPLASVEMEAMEALPVTWGTSSRDEDLENCSHHL | 8329 | 8345;<br>8346 |
| IgE leader | MDWTWILFLVAAATRVHS | 276 | 277 |
| SG3-(SG4)3-SG3-SLQ linker | SGGGSGGGGSGGGGSGGGGSGGGSLQ | 323 | 324 |
| SG Linker | SG | — | AGTG<br>GT |
| GSGSGS linker | GSGSGS | 8330 | 8347 |

TABLE 18-continued

DD-IL15-IL15Ra construct sequences

| Description/ Construct ID | Amino Acid Sequence | AA SEQ ID NO | NA SEQ ID NO |
|---|---|---|---|
| GSGSGSGS linker | GSGSGSGS | 8331 | 8348 |
| GSGSGGGSGS linker | GSGSGGGSGS | 8332 | 8349 |
| hPDE5 (Amino acid 535-860 of WT) | EETRELQSLAAAVVPSAQTLKITDFSFSDFELSDLETALCT IRMFTDLNLVQNFQMKHEVLCRWILSVKKNYRKNVAYH NWRHAFNTAQCMFAALKAGKIQNKLTDLEILALLIAALS HDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKP WPIQQRIAELVAIEFFDQGDRERKELNIEPTDLMNREKK NKIPSMQVGFIDAICLQLYEALTHVSEDCFPLLDGCRKNR QKWQALAEQQ | 3 | 339 |
| hPDE5 (Amino acid 535-860 of WT, R732L) | EETRELQSLAAAVVPSAQTLKITDFSFSDFELSDLETALCT IRMFTDLNLVQNFQMKHEVLCRWILSVKKNYRKNVAYH NWRHAFNTAQCMFAALKAGKIQNKLTDLEILALLIAALS HDLDHRGVNNSYIQRSEHPLAQLYCHSIMEHHHFDQCL MILNSPGNQILSGLSIEEYKTTLKIIKQAILATDLALYIKRL GEFFELIRKNQFNLEDPHQKELFLAMLMTACDLSAITKP WPIQQRIAELVAIEFFDQGDRERKELNIEPTDLMNREKK NKIPSMQVGFIDAICLQLYEALTHVSEDCFPLLDGCRKNR QKWQALAEQQ | 12 | 359 |
| hPDE5 (Amino acid 535-860 of WT, R732L, F736A) | EETRELQSLAAAVVPSAQTLKITDFSFSDFELSDLETALCT IRMFTDLNLVQNFQMKHEVLCRWILSVKKNYRKNVAYH NWRHAFNTAQCMFAALKAGKIQNKLTDLEILALLIAALS HDLDHRGVNNSYIQRSEHPLAQLYCHSIMEHHHFDQCL MILNSPGNQILSGLSIEEYKTTLKIIKQAILATDLALYIKRL GEFAELIRKNQFNLEDPHQKELFLAMLMTACDLSAITKP WPIQQRIAELVAIEFFDQGDRERKELNIEPTDLMNREKK NKIPSMQVGFIDAICLQLYEALTHVSEDCFPLLDGCRKNR QKWQALAEQQ | 227 | 233 |
| AcGFP (Amino acid 2-239 of WT) | VSKGAELFTGIVPILIELNGDVNGHKFSVSGEGEGDATYG KLTLKFICTTGKLPVPWPTLVTTLSYGVQCFSRYPDHMK QHDFFKSAMPEGYIQERTIFFEDDGNYKSRAEVKFEGDT LVNRIELTGTDFKEDGNILGNKMEYNYNAHNVYIMTDK AKNGIKVNFKIRHNIEDGSVQLADHYQQNTPIGDGPVLLP DNHYLSTQSALSKDPNEKRDHMIYFGFVTAAAITHGMDE LYK | 79 | 372 |
| FLAG-tag | DYKDDDDK | 8333 | 8350 |
| HA Tag | YPYDVPDYA | 8238 | 8351 |
| Modified Furin | ESRRVRRNKRSK | 288 | 291 |
| OT-IL15-031 (OT-001254, OT-IL15-045) IgE signal sequence; IL15 (Amino acid 49-162 of WT); linker (SG3-(SG4)3-SG3-SLQ); IL15Ra (Amino acid 31-267 of WT); linker (SG); hPDE5 (Amino acid 535-860 of WT, R732L, F736A); stop TGA | MDWTWILFLVAAATRVHSNWVNVISDLKKIEDLIQSMHI DATLYTESDVHPSCKVTAMKCFLLELQVISLESGDASIHD TVENLIILANNSLSSNGNVTESGCKECEELEEKNIKEFLQS FVHIVQMFINTSSGGGSGGGGSGGGGSGGGGSGGGSLQI TCPPPMSVEHADIWVKSYSLYSRERYICNSGFKRKAGTSS LTECVLNKATNVAHWTTPSLKCIRDPALVHQRPAPPSTV TTAGVTPQPESLSPSGKEPAASSPSSNNTAATTAAIVPGSQ LMPSKSPSTGTTEISSHESSHGTPSQTTAKNWELTASASH QPPGVYPQGHSDTTVAISTSTVLLCGLSAVSLLACYLKSR QTPPLASVEMEAMEALPVTWGTSSRDEDLENCSHHLSGE ETRELQSLAAAVVPSAQTLKITDFSFSDFELSDLETALCTI RMFTDLNLVQNFQMKHEVLCRWILSVKKNYRKNVAYH NWRHAFNTAQCMFAALKAGKIQNKLTDLEILALLIAALS HDLDHRGVNNSYIQRSEHPLAQLYCHSIMEHHHFDQCL MILNSPGNQILSGLSIEEYKTTLKIIKQAILATDLALYIKRL GEFAELIRKNQFNLEDPHQKELFLAMLMTACDLSAITKP WPIQQRIAELVAIEFFDQGDRERKELNIEPTDLMNREKK NKIPSMQVGFIDAICLQLYEALTHVSEDCFPLLDGCRKNR QKWQALAEQQ* | 8334 | 8352 |
| OT-IL15-032 (OT-001469) IgE signal sequence; IL15 | MDWTWILFLVAAATRVHSNWVNVISDLKKIEDLIQSMHI DATLYTESDVHPSCKVTAMKCFLLELQVISLESGDASIHD TVENLIILANNSLSSNGNVTESGCKECEELEEKNIKEFLQS FVHIVQMFINTSSGGGSGGGGSGGGGSGGGGSGGGSLQI | 8335 | 8353 |

TABLE 18-continued

DD-IL15-IL15Ra construct sequences

| Description/ Construct ID | Amino Acid Sequence | AA SEQ ID NO | NA SEQ ID NO |
| --- | --- | --- | --- |
| (Amino acid 49-162 of WT); linker (SG3-(SG4)3-SG3-SLQ); IL15Ra (Amino acid 31-267 of WT); linker (SG); AcGFP (Amino acid 2-239 of WT); linker (SG); hPDE5 (Amino acid 535-860 of WT, R732L, F736A); stop | TCPPPMSVEHADIWVKSYSLYSRERYICNSGFKRKAGTSS LTECVLNKATNVAHWTTPSLKCIRDPALVHQRPAPPSTV TTAGVTPQPESLSPSGKEPAASSPSSNNTAATTAAIVPGSQ LMPSKSPSTGTTEISSHESSHGTPSQTTAKNWELTASASH QPPGVYPQGHSDTTVAISTSTVLLCGLSAVSLLACYLKSR QTPPLASVEMEAMEALPVTWGTSSRDEDLENCSHHLSG VSKGAELFTGIVPILIELNGDVNGHKFSVSGEGEGDATYG KLTLKFICTTGKLPVPWPTLVTTLSYGVQCFSRYPDHMK QHDFFKSAMPEGYIQERTIFFEDDGNYKSRAEVKFEGDT LVNRIELTGTDFKEDGNILGNKMEYNYNAHNVYIMTDK AKNGIKVNFKIRHNIEDGSVQLADHYQQNTPIGDGPVLLP DNHYLSTQSALSKDPNEKRDHMIYFGFVTAAAITHGMDE LYKSGEETRELQSLAAAVVPSAQTLKITDFSFSDFELSDL ETALCTIRMFTDLNLVQNFQMKHEVLCRWILSVKKNYR KNVAYHNWRHAFNTAQCMFAALKAGKIQNKLTDLEILA LLIAALSHDLDHRGVNNSYIQRSEHPLAQLYCHSIMEHH HFDQCLMILNSPGNQILSGLSIEEYKTTLKIIKQAILATDL ALYIKRLGEFAELIRKNQFNLEDPHQKELFLAMLMTACD LSAITKPWPIQQRIAELVATEFFDQGDRERKELNIEPTDL MNREKKNKIPSMQVGFIDAICLQLYEALTHVSEDCFPLLD GCRKNRQKWQALAEQQ* | | |
| OT-IL15-033 (OT-001470) IgE signal sequence; IL15 (Amino acid 49-162 of WT); linker (SG3-(SG4)3-SG3-SLQ); IL15Ra (Amino acid 31-267 of WT); linker (SG); hPDE5 (Amino acid 535-860 of WT, R732L, F736A); linker (SG); AcGFP (Amino acid 2-239 of WT); stop | MDWTWILFLVAAATRVHSNWVNVISDLKKIEDLIQSMHI DATLYTESDVHPSCKVTAMKCFLLELQVISLESGDASIHD TVENLIILANNSLSSNGNVTESGCKECEELEEKNIKEFLQS FVHIVQMFINTSSGGGSGGGGSGGGGSGGGGSGGGSLQI TCPPPMSVEHADIWVKSYSLYSRERYICNSGFKRKAGTSS LTECVLNKATNVAHWTTPSLKCIRDPALVHQRPAPPSTV TTAGVTPQPESLSPSGKEPAASSPSSNNTAATTAAIVPGSQ LMPSKSPSTGTTEISSHESSHGTPSQTTAKNWELTASASH QPPGVYPQGHSDTTVAISTSTVLLCGLSAVSLLACYLKSR QTPPLASVEMEAMEALPVTWGTSSRDEDLENCSHHLSGE ETRELQSLAAAVVPSAQTLKITDFSFSDFELSDLETALCTI RMFTDLNLVQNFQMKHEVLCRWILSVKKNYRKNVAYH NWRHAFNTAQCMFAALKAGKIQNKLTDLEILALLIAALS HDLDHRGVNNSYIQRSEHPLAQLYCHSIMEHHHFDQCL MILNSPGNQILSGLSIEEYKTTLKIIKQAILATDLALYIKRL GEFAELIRKNQFNLEDPHQKELFLAMLMTACDLSAITKP WPIQQRIAELVAIEFFDQGDRERKELNIEPTDLMNREKK NKIPSMQVGFIDAICLQLYEALTHVSEDCFPLLDGCRKNR QKWQALAEQQSGVSKGAELFTGIVPILIELNGDVNGHKF SVSGEGEGDATYGKLTLKFICTTGKLPVPWPTLVTTLSY GVQCFSRYPDHMKQHDFFKSAMPEGYIQERTIFFEDDGN YKSRAEVKFEGDTLVNRIELTGTDFKEDGNILGNKMEYN YNAHNVYIMTDKAKNGIKVNFKIRHNIEDGSVQLADHY QQNTPIGDGPVLLPDNHYLSTQSALSKDPNEKRDHMIYF GFVTAAAITHGMDELYK* | 8336 | 8354 |
| OT-IL15-043 (OT-001315) IgE signal sequence; IL15 (Amino acid 49-162 of WT); Linker (SG3-(SG4)3-SG3-SLQ); IL15Ra (Amino acid 31-267 of WT); Linker (SG); Furin cleavage site (ESRRVRRNKRSK); hPDE5 (Amino acid 535-860 of WT, R732L); stop | MDWTWILFLVAAATRVHSNWVNVISDLKKIEDLIQSMHI DATLYTESDVHPSCKVTAMKCFLLELQVISLESGDASIHD TVENLIILANNSLSSNGNVTESGCKECEELEEKNIKEFLQS FVHIVQMFINTSSGGGSGGGGSGGGGSGGGGSGGGSLQI TCPPPMSVEHADIWVKSYSLYSRERYICNSGFKRKAGTSS LTECVLNKATNVAHWTTPSLKCIRDPALVHQRPAPPSTV TTAGVTPQPESLSPSGKEPAASSPSSNNTAATTAAIVPGSQ LMPSKSPSTGTTEISSHESSHGTPSQTTAKNWELTASASH QPPGVYPQGHSDTTVAISTSTVLLCGLSAVSLLACYLKSR QTPPLASVEMEAMEALPVTWGTSSRDEDLENCSHHLSGE SRRVRRNKRSKEETRELQSLAAAVVPSAQTLKITDFSFSD FELSDLETALCTIRMFTDLNLVQNFQMKHEVLCRWILSV KKNYRKNVAYHNWRHAFNTAQCMFAALKAGKIQNKLT DLEILALLIAALSHDLDHRGVNNSYIQRSEHPLAQLYCHS IMEHHHFDQCLMILNSPGNQILSGLSIEEYKTTLKIIKQAIL ATDLALYIKRLGEFFELIRKNQFNLEDPHQKELFLAMLM TACDLSAITKPWPIQQRIAELVATEFFDQGDRERKELNIEP TDLMNREKKNKIPSMQVGFIDAICLQLYEALTHVSEDCFP LLDGCRKNRQKWQALAEQQ* | 8337 | 8355 |
| OT-IL15-044 (OT-001316) IgE signal sequence; IL15 (Amino acid 49-162 of WT); | MDWTWILFLVAAATRVHSNWVNVISDLKKIEDLIQSMHI DATLYTESDVHPSCKVTAMKCFLLELQVISLESGDASIHD TVENLIILANNSLSSNGNVTESGCKECEELEEKNIKEFLQS FVHIVQMFINTSSGGGSGGGGSGGGGSGGGGSGGGSLQI TCPPPMSVEHADIWVKSYSLYSRERYICNSGFKRKAGTSS LTECVLNKATNVAHWTTPSLKCIRDPALVHQRPAPPSTV | 8338 | 8356 |

TABLE 18-continued

DD-IL15-IL15Ra construct sequences

| Description/<br>Construct ID | Amino Acid Sequence | AA SEQ ID NO | NA SEQ ID NO |
|---|---|---|---|
| Linker (SG3-(SG4)3-SG3-SLQ); IL15Ra (Amino acid 31-267 of WT); Linker (SG); hPDE5 (Amino acid 535-860 of WT, R732L); stop | TTAGVTPQPESLSPSGKEPAASSPSSNNTAATTAAIVPGSQ LMPSKSPSTGTTEISSHESSHGTPSQTTAKNWELTASASH QPPGVYPQGHSDTTVAISTSTVLLCGLSAVSLLACYLKSR QTPPLASVEMEAMEALPVTWGTSSRDEDLENCSHHLSGE ETRELQSLAAAVVPSAQTLKITDFSFSDFELSDLETALCTI RMFTDLNLVQNFQMKHEVLCRWILSVKKNYRKNVAYH NWRHAFNTAQCMFAALKAGKIQNKLTDLEILALLIAALS HDLDHRGVNNSYIQRSEHPLAQLYCHSIMEHHHFDQCL MILNSPGNQILSGLSIEEYKTTLKIIKQAILATDLALYIKRL GEFFELIRKNQFNLEDPHQKELFLAMLMTACDLSAITKP WPIQQRIAELVAIEFFDQGDRERKELNIEPTDLMNREKK NKIPSMQVGFIDAICLQLYEALTHVSEDCFPLLDGCRKNR QKWQALAEQQ* | | |
| OT-IL15-048 (OT-001317) IgE signal sequence; IL15 (Amino acid 49-162 of WT); Linker (SG3-(SG4)3-SG3-SLQ); IL15Ra (Amino acid 31-267 of WT); linker (SG); hPDE5 (Amino acid 535-860 of WT); stop | MDWTWILFLVAAATRVHSNWVNVISDLKKIEDLIQSMHI DATLYTESDVHPSCKVTAMKCFLLELQVISLESGDASIHD TVENLIILANNSLSSNGNVTESGCKECEELEEKNIKEFLQS FVHIVQMFINTSSGGGSGGGGSGGGGSGGGGSGGGSLQI TCPPPMSVEHADIWVKSYSLYSRERYICNSGFKRKAGTSS LTECVLNKATNVAHWTTPSLKCIRDPALVHQRPAPPSTV TTAGVTPQPESLSPSGKEPAASSPSSNNTAATTAAIVPGSQ LMPSKSPSTGTTEISSHESSHGTPSQTTAKNWELTASASH QPPGVYPQGHSDTTVAISTSTVLLCGLSAVSLLACYLKSR QTPPLASVEMEAMEALPVTWGTSSRDEDLENCSHHLSGE ETRELQSLAAAVVPSAQTLKITDFSFSDFELSDLETALCTI RMFTDLNLVQNFQMKHEVLCRWILSVKKNYRKNVAYH NWRHAFNTAQCMFAALKAGKIQNKLTDLEILALLIAALS HDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKP WPIQQRIAELVAIEFFDQGDRERKELNIEPTDLMNREKK NKIPSMQVGFIDAICLQLYEALTHVSEDCFPLLDGCRKNR QKWQALAEQQ* | 8339 | 8357 |
| OT-IL15-194 (OT-001499) IgE signal sequence; IL15 (Amino acid 49-162 of WT); Linker (SG3-(SG4)3-SG3-SLQ); IL15Ra (Amino acid 31-267 of WT); linker (SG); hPDE5 (Amino acid 535-860 of WT); stop | MDWTWILFLVAAATRVHSNWVNVISDLKKIEDLIQSMHI DATLYTESDVHPSCKVTAMKCFLLELQVISLESGDASIHD TVENLIILANNSLSSNGNVTESGCKECEELEEKNIKEFLQS FVHIVQMFINTSSGGGSGGGGSGGGGSGGGGSGGGSLQI TCPPPMSVEHADIWVKSYSLYSRERYICNSGFKRKAGTSS LTECVLNKATNVAHWTTPSLKCIRDPALVHQRPAPPSTV TTAGVTPQPESLSPSGKEPAASSPSSNNTAATTAAIVPGSQ LMPSKSPSTGTTEISSHESSHGTPSQTTAKNWELTASASH QPPGVYPQGHSDTTVAISTSTVLLCGLSAVSLLACYLKSR QTPPLASVEMEAMEALPVTWGTSSRDEDLENCSHHLSGE ETRELQSLAAAVVPSAQTLKITDFSFSDFELSDLETALCTI RMFTDLNLVQNFQMKHEVLCRWILSVKKNYRKNVAYH NWRHAFNTAQCMFAALKAGKIQNKLTDLEILALLIAALS HDLDHRGVNNSYIQRSEHPLAQLYCHSIMEHHHFDQCL MILNSPGNQILSGLSIEEYKTTLKIIKQAILATDLALYIKRR GEFFELIRKNQFNLEDPHQKELFLAMLMTACDLSAITKP WPIQQRIAELVATEFFDQGDRERKELNIEPTDLMNREKK NKIPSMQVGFIDAICLQLYEALTHVSEDCFPLLDGCRKNR QKWQALAEQQ* | 8340 | 8358 |
| OT-IL15-111 (OT-001344) IgE signal sequence; Flag tag; IL15 (Amino acid 49-162 of WT); Linker (SG3-(SG4)3-SG3-SLQ); HA tag; IL15Ra (Amino acid 31-267 of WT); linker (GSGSGS); hPDE5 (Amino acid 535-860 of WT, R732L); stop TGA | MDWTWILFLVAAATRVHSDYKDDDDKNWVNVISDLKK IEDLIQSMHIDATLYTESDVHPSCKVTAMKCFLLELQVIS LESGDASIHDTVENLIILANNSLSSNGNVTESGCKECEELE EKNIKEFLQSFVHIVQMFINTSSGGGSGGGGSGGGGSGG GGSGGGSLQYPYDVPDYAITCPPPMSVEHADIWVKSYSL YSRERYICNSGFKRKAGTSSLTECVLNKATNVAHWTTPS LKCIRDPALVHQRPAPPSTVTTAGVTPQPESLSPSGKEPA ASSPSSNNTAATTAAIVPGSQLMPSKSPSTGTTEISSHESS HGTPSQTTAKNWELTASASHQPPGVYPQGHSDTTVAIST STVLLCGLSAVSLLACYLKSRQTPPLASVEMEAMEALPV TWGTSSRDEDLENCSHHLSGSGSGSEETRELQSLAAAVVP SAQTLKITDFSFSDFELSDLETALCTIRMFTDLNLVQNFQ MKHEVLCRWILSVKKNYRKNVAYHNWRHAFNTAQCMF AALKAGKIQNKLTDLEILALLIAALSHDLDHRGVNNSYIQ RSEHPLAQLYCHSIMEHHHFDQCLMILNSPGNQILSGLSIE EYKTTLKIIKQAILATDLALYIKRLGEFFELIRKNQFNLED PHQKELFLAMLMTACDLSAITKPWPIQQRIAELVATEFFD QGDRERKELNIEPTDLMNREKKNKIPSMQVGFIDAICLQL YEALTHVSEDCFPLLDGCRKNRQKWQALAEQQ* | 8341 | 8359 |

TABLE 18-continued

DD-IL15-IL15Ra construct sequences

| Description/ Construct ID | Amino Acid Sequence | AA SEQ ID NO | NA SEQ ID NO |
|---|---|---|---|
| OT-IL15-112 (OT-001345) IgE signal sequence; Flag tag; IL15 (Amino acid 49-162 of WT); Linker (SG3-(SG4)3-SG3-SLQ); HA tag; IL15Ra (Amino acid 31-267 of WT); linker (GSGSGSGS); hPDE5 (Amino acid 535-860 of WT, R732L); stop | MDWTWILFLVAAATRVHSDYKDDDDKNWVNVISDLKK IEDLIQSMHIDATLYTESDVHPSCKVTAMKCFLLELQVIS LESGDASIHDTVENLIILANNSLSSNGNVTESGCKECEELE EKNIKEFLQSFVHIVQMFINTSSGGGSGGGGSGGGGSGG GGSGGGSLQYPYDVPDYAITCPPPMSVEHADIWVKSYSL YSRERYICNSGFKRKAGTSSLTECVLNKATNVAHWTTPS LKCIRDPALVHQRPAPPSTVTTAGVTPQPESLSPSGKEPA ASSPSSNNTAATTAAIVPGSQLMPSKSPSTGTTEISSHESS HGTPSQTTAKNWELTASASHQPPGVYPQGHSDTTVAIST STVLLCGLSAVSLLACYLKSRQTPPLASVEMEAMEALPV TWGTSSRDEDLENCSHHLGSGSGSGSEETRELQSLAAAV VPSAQTLKITDFSFSDFELSDLETALCTIRMFTDLNLVQNF QMKHEVLCRWILSVKKNYRKNVAYHNWRHAFNTAQC MFAALKAGKIQNKLTDLEILALLIAALSHDLDHRGVNNS YIQRSEHPLAQLYCHSIMEHHHFDQCLMILNSPGNQILSG LSIEEYKTTLKIIKQAILATDLALYIKRLGEFFELIRKNQFN LEDPHQKELFLAMLMTACDLSAITKPWPIQQRIAELVATE FFDQGDRERKELNIEPTDLMNREKKNKIPSMQVGFIDAIC LQLYEALTHVSEDCFPLLDGCRKNRQKWQALAEQQ* | 8342 | 8360 |
| OT-IL15-113 (OT-001346) IgE signal sequence; Flag tag; IL15 (Amino acid 49-162 of WT); Linker (SG3-(SG4)3-SG3-SLQ); HA tag; IL15Ra (Amino acid 31-267 of WT); linker (GSGSGGGSGS); hPDE5 (Amino acid 535-860 of WT, R732L); stop | MDWTWILFLVAAATRVHSDYKDDDDKNWVNVISDLKK IEDLIQSMHIDATLYTESDVHPSCKVTAMKCFLLELQVIS LESGDASIHDTVENLIILANNSLSSNGNVTESGCKECEELE EKNIKEFLQSFVHIVQMFINTSSGGGSGGGGSGGGGSGG GGSGGGSLQYPYDVPDYAITCPPPMSVEHADIWVKSYSL YSRERYICNSGFKRKAGTSSLTECVLNKATNVAHWTTPS LKCIRDPALVHQRPAPPSTVTTAGVTPQPESLSPSGKEPA ASSPSSNNTAATTAAIVPGSQLMPSKSPSTGTTEISSHESS HGTPSQTTAKNWELTASASHQPPGVYPQGHSDTTVAIST STVLLCGLSAVSLLACYLKSRQTPPLASVEMEAMEALPV TWGTSSRDEDLENCSHHLGSGSGGGSGSEETRELQSLAA AVVPSAQTLKITDFSFSDFELSDLETALCTIRMFTDLNLV QNFQMKHEVLCRWILSVKKNYRKNVAYHNWRHAFNTA QCMFAALKAGKIQNKLTDLEILALLIAALSHDLDHRGVN NSYIQRSEHPLAQLYCHSIMEHHHFDQCLMILNSPGNQIL SGLSIEEYKTTLKIIKQAILATDLALYIKRLGEFFELIRKNQ FNLEDPHQKELFLAMLMTACDLSAITKPWPIQQRIAELV ATEFFDQGDRERKELNIEPTDLMNREKKNKIPSMQVGFID AICLQLYEALTHVSEDCFPLLDGCRKNRQKWQALAEQQ* | 8343 | 8361 |

In some embodiments, the sequences described in Table 18, may contain an additional stop codon. For example, the construct "hPDE5 (Amino acid 535-860 of WT, R732L); stop" may be encoded by the nucleotide sequence of SEQ ID NO. 8362, and the construct "hPDE5 (Amino acid 535-860 of WT, R732L, F736A); stop" may be encoded by the nucleotide sequence of SEQ ID NO. 8363.

In one embodiment, the payload of the present invention may comprise IL18. IL18 is a proinflammatory and immune regulatory cytokine that promotes IFNγ production by T and NK cells. IL18 belongs to the IL1 family. Secreted L18 binds to a heterodimer receptor complex, consisting of IL18Rα and β-chains and initiates signal transduction. IL18 acts in concert with other cytokines to modulate immune system functions, including induction of IFN γ production, Th1 responses, and NK cell activation in response to pathogen products. IL18 showed anti-cancer effects in several tumors. Administration of recombinant IL18 protein or IL18 transgene induces melanoma or sarcoma regression through the activation of CD4+ T and/or NK cell-mediated responses (reviewed by Srivastava et al., *Curr. Med. Chem.*, 2010, 17: 3353-3357). The combination of IL18 with other cytokines, such as IL12 or co-stimulatory molecules (e.g., CD80) increases IL18 anti-tumor effects. For example, IL18 and IL12A/B or CD80 genes have been integrated successfully in the genome of oncolytic viruses, with the aim to trigger synergistically T cell-mediated anti-tumor immune responses (Choi et al., *Gene Ther.*, 2011, 18: 898-909). IL2/IL18 fusion proteins also display enhanced anti-tumor properties relative to either cytokine alone and low toxicity in preclinical models (Acres et al., *Cancer Res.*, 2005, 65:9536-9546).

IL18 alone, or in combination of IL12 and IL15, activates NK cells. Preclinical studies have demonstrated that adoptively transferred IL12, IL15 and L 18 pre-activated NK cells display enhanced effector function against established tumors in vivo (Ni et al., *J Exp Med.* 2012, 209: 2351-2365; and Romee et al., *Blood.* 2012, 120:4751-4760). Human IL12/IL15/IL18 activated NK cells also display memory-like features and secrete more IFN γ in response to cytokines (e.g., low concentration of IL2). In one embodiment, the effector module of the present invention may be a DD-IL18 fusion polypeptide.

In one embodiment, the payload of the present invention may comprise IL21. IL21 is another pleiotropic type I cytokine that is produced mainly by T cells and natural killer T (NKT) cells. IL21 has diverse effects on a variety of cell types including but not limited to CD4+ and CD8+ T cells, B cells, macrophages, monocytes, and dendritic cells (DCs). The functional receptor for IL21 is composed of IL21 receptor (IL21R) and the common cytokine receptor gamma chain, which is also a subunit of the receptors for IL2, IL4, IL7, IL9 and IL15. Studies provide compelling evidence that IL21 is a promising immunotherapeutic agent for cancer immunotherapy. IL21 promotes maturation, enhances cytotoxicity, and induces production of IFN γ and perforin by NK cells. These effector functions inhibit the growth of B16 melanoma (Kasaian et al., *Immunity.* 2002, 16(4):559-569; and Brady et al., *J Immunol.* 2004, 172(4):2048-2058). IL21 together with IL15 expands antigen-specific CD8$^+$ T-cell numbers and their effector function, resulting in tumor regression (Zeng et al., *J Exp Med.* 2005, 201(1): 139-148). IL21 may also be used to rejuvenate multiple immune effector cells in the tumor microenvironment. IL21 may also directly induce apoptosis in certain types of lymphoma such as diffuse large B-cell lymphoma, mantle cell lymphoma, and chronic lymphocytic leukemia cells, via activation of STAT3 or STAT1 signal pathway. IL21, alone or in combination with anti-CD20 mAb (rituximab) can activate NK cell-dependent cytotoxic effects. Interestingly, discovery of the immunosuppressive actions of IL21 suggests that this cytokine is a "double-edged sword"-IL21 stimulation may lead to either the induction or suppression of immune responses. Both stimulatory and suppressive effects of IL21 must be considered when using IL21-related immunotherapeutic agents. The level of IL21 needs to be tightly controlled by regulatory elements. In one aspect, the effector module of the present invention may be a DD-IL21 fusion polypeptide.

In some embodiments, payloads of the present invention may comprise type I interferons. Type I interferons (IFNs-I) are soluble proteins important for fighting viral infection in humans. IFNs-I include IFN alpha subtypes (IFN α1, IFN α1b, IFN α1c), IFN beta, IFN delta subtypes (IFN delta 1, IFN delta 2, IFN delta 8), IFN gamma, IFN kappa, and IFN epsilon, IFN lambda, IFN omega, IFN tau and IFN zeta. IFN α and IFN β are the main IFN I subtypes in immune responses. All subtypes of IFN I signal through a unique heterodimeric receptor, interferon alpha receptor (IFNAR), composed of 2 subunits, IFNAR1 and IFNAR2. IFNR activation regulates the host response to viral infections and in adaptive immunity. Several signaling cascades can be activated by IFNR, including the Janus activated kinase-signal transducer and activation of transcription (JAK-STAT) pathway, the mitogen activated protein kinase (MAPK) pathway, the phosphoinositide 3-kinase (PI3K) pathway, the v-crk sarcoma virus CT10 oncogene homolog (avian)-like (CRKL) pathway, and NF-κB cascade. It has long been established that type I IFNs directly inhibit the proliferation of tumor cells and virus-infected cells, and increase MHC class I expression, enhancing antigen recognition. IFNs-I have also proven to be involved in immune system regulation. IFNs can either directly, through interferon receptor (IFNR), or indirectly by the induction of chemokines and cytokines, regulate the immune system. Type I IFNs enhance NK cell functions and promote survival of NK cells. Type I IFNs also affect monocytes, supporting the differentiation of monocytes into DC with high capacity for antigen presentation, and stimulate macrophage function and differentiation. Several studies also demonstrate that IFNs-I promote CD8$^+$ T cell survival and functions. In some instances, it may be desirable to tune the expression of Type I IFNs using biocircuits of the present invention to avoid immunosuppression caused by long-term treatment with IFNs.

New anticancer immunotherapies are being developed that use recombinant type I IFN proteins, type I IFN transgene, type I IFN encoding vectors and type I IFN expressing cells. For example, IFN α has received approval for treatment of several neoplastic diseases, such as melanoma, RCC and multiple myeloma. Though type I IFNs are powerful tools to directly and indirectly modulate the functions of the immune system, side effects of systemic long-term treatments and lack of sufficiently high efficacy have dampened the interest of IFN α for clinical use in oncology. It is believed that if IFN levels are tightly regulated at the malignant tissues, type I IFNs are likely more efficacious. Approaches for intermittent delivery are proposed according to the observation that intermittency at an optimized pace may help to avoid signaling desensitizing mechanisms (negative feedback mechanisms) induced by IFNs-I (i.e., because of SOCS1 induction) in the responding immune cells. In accordance with the present invention, the effector module may comprise a DD-IFN fusion polypeptide. The DD and its ligand control the expression of IFN to induce an antiviral and antitumor immune responses and in the meantime, to minimize the side effects caused by long-term exposure of IFN.

In some embodiments, payloads of the present invention may comprise members of tumor necrosis factor (TNF) superfamily. The term "TNF superfamily" as used herein refers to a group of cytokines that can induce apoptosis. Members of TNF family include TNF-alpha, TNF-beta (also known as lymphotoxin-alpha (LT-α)), lymphotoxin-beta (LT-β), CD40L(CD154), CD27L (CD70), CD30L(CD153), FASL(CD178), 4-1BBL (CD137L), OX40L, TRAIL (TNF-related apoptosis inducing ligand), APRIL (a proliferation-inducing ligand), TWEAK, TRANCE, TALL-1, GITRL, LIGHT and TNFSF1 to TNFSF20 (TNF ligand superfamily member 1 to 20). In one embodiment, the payload of the invention may be TNF-alpha. TNF-alpha can cause cytolysis of tumor cells, and induce cell proliferation differentiation as well. In one aspect, the effector module of the present invention may comprise a DD-TNF alpha fusion polypeptide.

In one embodiment, the payloads of the present invention may be cytokines fused to TNF alpha ectodomain. Such payloads are produced as membrane associated cytokines fused to the TNF ectodomain. In one embodiment, the cytokine may be shed from the cell surface by the action of membrane associated proteases, and/or proteases in the extracellular space e.g. MMP9. Any of the cytokines described herein may be useful in the present invention. Such cytokine-TNF scaffold constructs may be used to preserve the native sequence of the processed cytokine while preserving regulation.

In some embodiments, payloads of the present invention may comprise inhibitory molecules that block inhibitory cytokines. The inhibitors may be blocking antibodies specific to an inhibitory cytokine, and antagonists against an inhibitory cytokine, or the like.

In some aspects, payloads of the present invention may comprise an inhibitor of a secondary cytokine IL35. IL35 belongs to the interleukin-12 (IL12) cytokine family, and is a heterodimer composed of the IL27 β chain Ebi3 and the IL12 α chain p35. Secretion of bioactive IL35 has been described only in forkhead box protein 3 (Foxp3)$^+$ regulatory T cells (Tregs) (resting and activated Tregs). Unlike other membranes in the family, IL35 appears to function solely in an anti-inflammatory fashion by inhibiting effector T cell proliferation and perhaps other parameters (Collison et al., *Nature,* 2007, 450(7169): 566-569).

In some embodiments, payloads of the present invention may comprise inhibitors that block the transforming growth factor beta (TGF-β) subtypes (TGF-β1, TGF-β2 and TGF-β3). TGF-β is secreted by many cell types, including macrophages and is often complexed with two proteins LTBP and LAP. Serum proteinases such as plasmin catalyze the release of active TGF-β from the complex from the activated macrophages. It has been shown that an increase in expression of TGF-β correlates with the malignancy of many cancers. The immunosuppressive activity of TGF-β in the tumor microenvironment contributes to oncogenesis.

In some embodiments, payloads of the present invention may comprise inhibitors of IDO enzyme. In some embodiments, payloads fused to the DDs of the invention may be an inhibitor of an immunosuppressive molecule such as TGF-beta and IDO.

In some embodiments, payloads of the present invention may comprise chemokines and chemokine receptors. Chemokines are a family of secreted small cytokines, or signaling proteins that can induce directed chemotaxis in nearby responsive cells. The chemokine may be a SCY (small cytokine) selected from the group consisting of SCYA1-28 (CCL1-28), SCYB1-16 (CXCL1-16), SCYC1-2 (XCL1-2), SCYD-1 and SCYE-1; or a C chemokine selected from XCL1 and XCL2; or a CC chemokine selected from CCL1, CCL2, CCL3, CCL4, CCL5, CCL6, CCL7, CCL8, CCL9, CCL10, CCL11, CCL12, CCL13, CCL14, CCL15, CCL16, CCL17, CCL18, CCL19, CCL20, CCL21, CCL22, CCL23, CCL24, CCL25, CCL26, CCL27 and CCL28; or a CXC chemokine selected from CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16 and CXCL17; or a CX3C chemokine CX3CL1. In some aspects, the chemokine receptor may be a receptor for the C chemokines including XCR1; or a receptor for the CC chemokines including CCR1, CCR2, CCR3, CCR4, CCR5, CCR6, CCR7, CCR8, CCR9 and CCR10; or a receptor for the CXC chemokines including CXCR1, CXCR2, CXCR3, CXCR4 and CXCR5; or a CX3C chemokine receptor CX3CR1.

In some embodiments, payloads of the present invention may comprise other immunomodulators that play a critical role in immunotherapy, such as GM-CSF (Granulocyte-macrophage colony stimulating factor), erythropoietin (EPO), MIP3a, monocyte chemotactic protein (MCP)-1, intracellular adhesion molecule (ICAM), macrophage colony stimulating factor (M-CSF), Interleukin-1 receptor activating kinase (iRAK-1), lactotransferrin, and granulocyte colony stimulating factor (G-CSF).

In some embodiments, the payload of the present invention may comprise Amphiregulin. Amphiregulin (AREG) is an EGF-like growth factor which binds to the EGFR receptor and enhances CD4+ regulatory T cells (Tregs) function. AREG promotes immune suppression in the tumor environment. Thus, in some embodiment, the payloads of the present invention may comprise Amhiregulin to dampen immune response during immunotherapy.

In some embodiments, payloads of the present invention may comprise fusion proteins wherein a cytokine, chemokine and/or other soluble factor may be fused to other biological molecules such as antibodies and or ligands for a receptor. Such fusion molecules may increase the half-life of the cytokines, reduce systemic toxicity, and increase local concentration of the cytokines at the tumor site. Fusion proteins containing two or more cytokines, chemokines and or other soluble factors may be utilized to obtain synergistic therapeutic benefits. In one embodiment, payload may be a GM-CSF/IL2 fusion protein.

In some embodiments, any of the hinge and transmembrane domains described herein may be used as a scaffold for soluble cytokine presentation. The cytokine may be operably linked to the CD8 hinge and transmembrane domain by a protease cleavage site. Cleavage at the cleavage site releases the cytokine from the cell surface membrane. In some aspects, the cytokine may be in a precursor form. Generation of the active form of the cytokine from the precursor form occurs via cleavage at the cleavage site. Any of the cytokines described herein may be engineered using the any of the hinge and transmembrane domains described herein as a scaffold.

7. Immune Regulators

In some embodiments, payloads of the present invention may comprise inhibitors (antagonists) of co-inhibitory molecules (e.g., immune checkpoint), including without limitation, PD-1, PD-L1, PD-L2, CTLA-4, TIM-3, VISTA, BTLA, TIGIT, LAIRA, CD160, 2B4 and TGFR. In some aspects, the inhibitor may be a blocking/antagonistic antibody or fragment thereof, as discussed previously, or a ligand of the co-inhibitory receptor.

In some embodiments, payloads of the present invention may comprise agonists of co-stimulatory molecules, including without limitation, CD27, CD28, CD30, CD40, OX40 (CD134), 4-1BB (CD137), CDS, ICAM-1, LFA-1 (CD11a/CD18), ICOS (CD278), GITR, BAFFR, HVEM, CD7, LIGHT, NKG2C, SLAMF7, NKp80, CD160, B7-H3 and CD83. As a non-limiting example, agonists of co-stimulatory molecule ICOS (CD278) may be an ICOS binding protein comprising an amino acid sequence of SEQ ID NOs: 1, 2, 3, 4, 5 and 6 disclosed in International Patent Publication NO: WO2016120789; the contents of which are incorporated by reference herein in their entirety.

In some aspects, the agonist of a co-stimulatory molecule may be an agonistic antibody or fragment thereof, as discussed previously; or a ligand of the co-stimulatory receptor; or any binding molecules that can enhance the biological activity of its target. For example, an agonistic ligand of OX40 may be OX40L (CD252). The OX40 ligand as used herein, includes the intact OX40 ligand, soluble OX40 ligand, fusion proteins including a functionally active portion of OX40 ligand covalently linked to a second moiety, e.g., a protein domain, and variants may be which vary in amino acid sequence from naturally occurring OX4L but which retain the ability to specifically bind to the OX40 receptor or even enhance the biological activity of OX40L.

In general, an agonist of a co-stimulatory molecule substantially enhances the biological activity of its target molecule, such as T cell activation. Desirably, the biological activity is enhanced by 10, 20, 30, 50, 70, 80, 90, 95, or even 100.

In some embodiments, payloads of the present invention may comprise immunomodulators including stress proteins and heat shock proteins (HSPs) that can integrate both innate and adaptive immune responses. They may also be other chaperones and adaptors that stimulate immune responses. As a non-limiting example, the payload of the present invention may be a fusion protein comprising an NF-KB-activating domain of Flagellin fused with an ATP-binding domain truncated glucose regulated protein 170 (Grp170) (See. US patent publication NO.: US2015/0315255; the contents of which are incorporated herein by reference in their entirety). The fusion construct forms a secretable Grp170-Flagellin hybrid chaperone (Flagrp170) which can be used to stimulate anti-cancer immune responses.

In other embodiments, the payload of the present invention may comprise a STING (stimulator of interferon gene) protein, an adaptor molecule in the cytoplasm which, as a component of the host cytosolic surveillance pathway, activates the TANK binding kinase (TBK1)-IRF3 signaling axis, resulting in the induction of IFN β and other IRF-3 dependent gene products that strongly activate innate immunity, leading to the development of an adaptive immune response consisting of both antigen-specific CD4$^+$ and CD8$^+$ T cells as well as pathogen-specific antibodies.

Demaria et al. reported that enforced activation of a STING protein by intratumoral injection of cyclic dinucleotide GMP-AMP (cGAMP), an agonist of STING, can enhance antitumor CD8$^+$ T cell responses leading to growth control of injected and contralateral tumors in mouse models of melanoma and colon cancer. The STING-dependent antitumor immunity was dependent on type I IFNs produced by endothelial cells in the tumor microenvironment (Demaria et al., *Proc. Natl. Acad. Sci. USA,* 2015, 112(5): 15408-15413). These studies demonstrate that STING contributes to anti-tumor immune responses via enhancement of type I IFN signaling in the tumor microenvironment. Biocircuits, effector modules comprising STING may be applied to the tumor microenvironment to enhance anti-tumor responses either alone or in combination with other immunotherapeutic agents of the invention.

In addition to STING proteins, payloads of the present invention may comprise PRRs (pattern recognition receptors) that are involved in sensing the infection of cells by viruses and microorganisms to activate innate immune inflammatory responses. Such PRRs include Toll like receptors (TLRs), RIG-I-like receptors (RLRs), NOD-like receptors (NLRs), and C-type lectin receptors (CLRs). The RLR family is a RNA sensing system that is comprised of retinoic acid inducible gene-like-I (RIG-1), melanoma differentiation-associated gene 5 (MDA5), and laboratory of genetics and physiology 2 (LGP2). RIG-1 recognizes relatively short dsRNA (up to 1 kb) whereas MDA5 detects long dsRNA (more than 2 kb) to activate synthesis of type I IFNs, including IFN α and IFN β (Wilkins et al., *Curr Opin Immunol.,* 2010, 22: 41-47). RLRs activate downstream signaling proteins evoking type I IFN production. TLRs recognize distinct structures in microbes; often referred to as "PAMPs" (pathogen associated molecular patterns). Ligand binding to TLRs invokes a cascade of intra-cellular signaling pathways that induce the production of factors involved in inflammation and immunity such as pro-inflammatory cytokines, and chemokines, as well as CD4$^+$ and CD8$^+$ T cell activation. Among ten TLRs identified in human, TLRs-1, 2, 4, 5 and 6 are expressed in the cell surface, while TLR-3, -7/8, and -9 are expressed with the ER compartment. In some embodiments, payloads of the invention may be one of the PRRs, or agonists of PRRs.

8. Metabolic Factors/Metabolic Checkpoint

In some embodiments, immune cells such as T cells used for immunotherapy may be metabolically reprogrammed to enhance anti-tumor T cell responses. Metabolic activities are necessary to support immune cells, specifically T cells growth, expansion, differentiation and effector functions, upon activation through T cell receptor or CAR and co-stimulatory signals. Metabolic competition between cancer cells and infiltrating immune effector cells leads to T cell energy and dysfunction.

In some embodiments, payloads of the present invention may be modulators of glycolysis. The Warburg effect in cancer cells leads to the massive generation of lactic acid that can suppress T cell cytotoxic and effector functions. As a non-limiting example, immune cells for adoptive transfer may be modified to overexpress phosphoenolpyruvate carboxykinase 1 (PCK1), which increases PEP production in T cells. Increased production of the glycolytic metabolite phosphoenolpyruvate (PEP) can repress sarco/ER Ca (2+)-ATPase (SERCA) activity, therefore sustaining T cell receptor-mediated Ca (2+)-NFAT signaling and effector functions (Ho et al, *Cell,* 2015, 162(6): 1217-1228).

In some embodiments, the payloads of the present invention may comprise of proteins involved in the OXPHOS pathway. For example, LEM (lymphocyte expansion molecule), a protein that can promote cytotoxic CD8$^+$ T cell proliferation and effector function, and memory T cell generation in response to infection with lymphocyte choriomeningitis (CMV). LEM is part of a complex of CRIF 1 (CR6 interacting factor 1) that mediates the translation and insertion of OXPHOS (Oxidative phosphorylation) proteins into mitochondrial inner membrane, thereby regulates OXPHOS activity. Thus, LEM is a positive modulator of T cell metabolism (mitochondria respiratory levels) and expansion (Okoye et al., *Science,* 2015, 348(6238): 995-1001).

In some embodiments, the payloads of the present invention may be inhibitors of metabolic enzymes involved in amino acid regulation. Metabolic competition for between immune cells and tumor cells can lead to establishing and maintaining an immunosuppressive tumor microenvironment due to T cell energy. Non-limiting examples include inhibitors of nitric oxide synthase and arginase I that can degrade extracellular arginine, or Indoleamine 2,3-dioxygense (IDO) that degrades tryptophan. Abrogation of these enzymes secreted by tumor cells and immune suppressive cells can promote antitumor immunity.

In other embodiments, payloads of the present invention may comprise proteins critical for de novo fatty acid and cholesterol biosynthesis. This may include proteins such as SREBP1 (also known as SREBF1), SREBP2 (SREBF2), HMGCR, HMGCS, FASN, ACACA and SQLE, and transport pathways, such as LDLR. Modulating cholesterol metabolism of cytotoxic CD8$^+$ T cells may potentiate their anti-tumor effector function and proliferation. Cholesterol is a key component of membrane lipids, and has been shown that the increase in the plasma membrane cholesterol level of CD8$^+$ T cells, enhances T-cell receptor clustering and signaling as well as more efficient formation of the immunological synapse (Molnar et al., *J Biol Chem.* 2012, 287: 42664-42674). T cells used for adoptive transfer (e.g., anti-tumor CAR T cells) may be further engineered to express a protein that enhances cholesterol biosynthesis and/or transportation.

9. Safety Switch

In some embodiments, payloads of the present invention may comprise SRE regulated safety switches that can eliminate adoptively transferred cells in the case of severe toxicity, thereby mitigating the adverse effects of T cell therapy. Adoptively transferred T cells in immunotherapy may attack normal cells in response to normal tissue expression of TAA. Even on-tumor target activity of adoptively transferred T cells can result in toxicities such as tumor lysis syndrome, cytokine release syndrome and the related macrophage activation syndrome.

In one embodiment, the payloads of the present invention may eliminate the inappropriately activated cells by induction of apoptosis or by immunosurveillance have been developed in the art.

In some embodiments, payloads of the present invention may comprise inducible killer/suicide genes that acts as a safety switch. The killer/suicide gene when introduced into adoptively transferred immune cells, could control their alloreactivity. The killer/suicide gene may be an apoptotic gene (e.g., a caspase) which allows conditional apoptosis of the transduced cells by administration of a non-therapeutic ligand of the SRE (e.g., DD).

In some embodiments, the payload of the present invention may include Caspase 9. In some instances, Caspase 9 may be modified to have low basal expression and lacking the caspase recruitment domain (CARD) (SEQ ID NO.: 26 and SEQ ID NO.: 28 of U.S. Pat. No. 9,434,935B2; the contents of which are incorporated by reference in their entirety).

In one embodiment, the payload of the present invention is a suicide gene system, iCasp9/Chemical induced dimerization (CID) system which consists of a polypeptide derived from the Caspase9 gene fused to a drug binding domain derived from the human FK506 protein. Administration of bioinert, small molecule AP1903(rimiducid), induces cross linking of the drug binding domains and dimerization of the fusion protein and in turn the dimerization of Caspase 9. This results in the activation of downstream effector Caspase 3 and subsequent induction of cellular apoptosis (Straathof et al., *Blood*, 2005, 105: 4247-4254; incorporated herein by reference in its entirety). Preclinical trials using CART including an iCasp9 gene have shown effective elimination of CAR T cells in vivo in mouse models and demonstrate the potential efficacy of this approach. (Budde et al, *Plos One*, 2013, 8: e82742.10.1371; Hoyos et al., *Leukemia*, 2010; 24(6):1160-1170). In one embodiment, the payload of the invention may comprise Caspase9. In one aspect, the effector module of the invention may be a DD-Caspase9 fusion polypeptide. In some embodiments, the payload of the invention may be full length Caspase 9 (SEQ ID NO. 8364, encoded by SEQ ID No. 8365, 8366) or caspase 9 delta CD (SEQ ID NO. 8367, encoded by SEQ ID No. 8368). The Caspases 9 sequences described herein may optionally include a stop codon at the C terminal of the sequence.

In some instances, the iCasp9/CID system has been shown to have a basal rate of dimerization even in the absence of rimiducid, resulting in unintended cell death. Regulating the expression levels of iCasp9/CID is critical for maximizing the efficacy of iCasp9/CID system. Biocircuits of the present invention and/or any of their components may be utilized in regulating or tuning the iCasp9/CID system in order to optimize its utility. Other examples of proteins used in dimerization-induced apoptosis paradigm may include, but are not limited to Fas receptor, the death effector domain of Fas-associated protein, FADD, Caspase 1, Caspase 3, Caspase 7 and Caspase 8. (Belshaw P. J. et al, *Chem Biol.*, 996, 3:731-738; MacCorkle R. A. et al, *Proc Natl Acad Sci*, 1998, 95:3655-3660; Spencer, D. M. et al., *Curr Biol.* 1996; 6:839-847; the contents of each of which are incorporated herein by reference in their entirety).

In some embodiments, the safety switch of the present invention may comprise a metabolic enzyme, such as herpes simplex virus thymidine kinase (HSV-TK) and cytosine deaminase (CD). HSV-TK phosphorylates nucleoside analogs, including acyclovir and ganciclovir (GCV) to generate triphosphate form of nucleosides. When incorporated into DNA, it leads to chain termination and cell death. Unlike the mammalian thymidine kinase, HSV-TK is characterized by 1000-fold higher affinity to nucleoside analogs such as GCV, making it suitable for use as a suicide gene in mammalian cells. Cytosine deaminase (CD) can converts 5-fluorocytosine (5-FC) into the cytotoxic 5-fluorouracil (5-FU) (Tiraby et al., *FEMS Lett.*, 1998, 167: 41-49).

In some embodiments, the safety switch of the present invention may comprise a CYP4B1 mutant (as suicide gene), which may be co-expressed in a CAR engineered T cells (Roellecker et al., *Gen Ther.*, 2016, May 19, doi: 10.1038/gt.2016.38.).

In some embodiments, the payload of the present invention may comprise a fusion construct that can induce cell death, for example, a polypeptide with the formula of St-R1-S1-Q-S2-R2, wherein the St is a stalk sequence, R1/2 and Q are different epitopes; and S1/2 are optional spacer sequences (See, International patent publication NO.: WO2013/153391; the content of which are incorporated herein by reference in their entirety).

In some embodiments, safety switch may be mediated by therapeutic antibodies which specifically bind to an antigen that is expressed in the plasma membrane of adoptively transferred cells. The antigen-antibody interaction allows cell removal after administration of a specific monoclonal antibody against the antigen. As non-limiting examples, payloads of the present invention may comprise the antigen and antibody pair used to mediate safety switch such as CD20 and anti-CD20 antibody (Griffioen et al., *Haematologica*, 2009, 94:1316-1320), a protein tag and anti-tag antibody (Kieback et al., *Natl. Acad. Sci. U.S.A.*, 2008, 105: 623-628), a compact suicide gene (RQR8) combining epitopes from CD34 (as a marker moiety) and CD20 (as a suicide moiety) which enables CD34 selection, cell tracking, as well as cell deletion after anti-CD20 monoclonal antibody administration (Philip et al., *Blood*, 2014, 124: 1277-1287); truncated human EGFR polypeptide and anti-EGFR monoclonal antibody (Wang et al., *Blood*, 2011, 118:1255-1263); and a compact polypeptide safety switch having a structural formula as discussed in U. S Patent Application Publication NO: 2015/0093401; the contents of each of which are incorporated herein by reference in their entirety.

10. Regulatory Switch

The utility of adoptive cell therapy (ACT) has been limited by the high incidence of graft versus host disease (GVHD). GVHD occurs when adoptively transferred T cells elicit an immune response resulting in host tissue damage. Recognition of host antigens by the graft cells triggers a proinflammatory cytokine storm cascade that signifies acute GVHD. GVHD is characterized as an imbalance between the effector and the regulatory arms of the immune system. In some embodiments, the payloads of the present invention may be used as regulatory switches. As used herein "regulatory switch" refers proteins, which when expressed in target cells increase tolerance to the graft by enhancing the regulatory arm of the immune system.

In one embodiment, regulatory switches may include payloads that preferentially promote the expansion of regulatory T (Treg cells). Tregs are a distinct population of cells that are positively selected on high affinity ligands in the thymus and play an important role in the tolerance to self-antigens. In addition, T regs have also been shown to play a role in peripheral tolerance to foreign antigens. Since Tregs promote immune tolerance, expansion of Tregs with the compositions of the invention may be desirable to limit GVHD.

In some embodiments, the regulatory switch may include, but is not limited to T regs activation factors such NFκB, FOXO, nuclear receptor Nr4a, Retinoic acid receptor alpha, NFAT, AP-1 and SMAD. Such factors can result in the expression of Fork headbox P3 (FOXP3) in T cells resulting in the activation of the regulatory T cell program and the expansion of T cells.

In one embodiment, the regulatory switch may be FOXP3, a transcriptional regulator in T cells. A function of FOXP3 is to suppress the function of NFAT, which leads to the suppression of expression of many genes including IL2 and effector T-cell cytokines. FOXP3 acts also as a transcription activator for genes such as CD2S, Cytotoxic T-Lymphocyte Antigen Cytotoxic T-Lymphocyte Antigen 4 (CTLA4), glucocorticoid-induced TNF receptor family gene (GITR) and folate receptor 4. FOXP3 also inhibits the differentiation of IL17 producing helper T-cells (Th17) by antagonizing RORC (RAR related orphan receptor C). Isoforms of FOXP3 lacking exon2 (FOXP3 delta 2), or exon 7 (FOXP3 delta 7) may also be used as regulatory switches. In one aspect, the effector module of the invention may be a DD-FOXP3 fusion polypeptide. FOXP3 may be a full length FOXP3 (SEQ ID NO. 8369, encoded by SEQ ID NO. 8370); or FOXP3 (amino acid 2-431 of WT) (SEQ ID NO.8371, encoded by SEQ ID NO. 8372), delta 2 FOXP3 (SEQ ID NO. 8373, encoded by SEQ ID NO. 8374); or FOXP3 delta (amino acid 2-396 of WT) (SEQ ID NO. 8375, encoded by SEQ ID NO. 8376).

11. Homing Receptors

In some embodiments, payloads of the present invention may comprise homing receptors that guide immunotherapeutic cells to different anatomical compartments, such as designated tumor sites. For example, T cells expressing a chimeric antigen receptor may be further modified to express a homing receptor that is not normally expressed by the T cell. As used herein, the term "homing receptor" is a receptor that guides a cell expressing the receptor to a designated organ, a particular tissue, or a particular type of cell. Such trafficking receptors favor T cell accumulation in certain target organs. In some embodiments, the homing receptors of the present invention may be adhesion molecules. In other embodiments, the homing receptors of the invention may be chemokine receptors which mediate chemotaxis to chemokines. As non-limiting examples, a homing receptor may be a B cell zone homing receptor such as CXCR5; T cell zone homing receptor such as CXCR7; a gastrointestinal homing receptor such as CCR9 and integrin α4β7 (also known as lymphocyte Peyer patch adhesion molecule); a skin homing receptor such as CLA (cutaneous lymphocyte-associated antigen receptor), CCR4, CCR8 and CCR10 (See, e.g., International Patent Publication NO.: WO2016025454; the contents of which are incorporated herein by reference in their entirety). Other homing receptors include, without limitation, CXCR2 and CXCR1 which redirect chemokine receptor modified tumor-infiltrating lymphocytes to melanoma tumor (Idorn et al., *Methods Mol. Biol.*, 2016, 1428: 261-276; and Sapoznik et al., *Cancer Immunol Immunother.*, 2012, 61(10): 1833-1847); CCR2 which, when expressed by CD8+ T cells, can home modified CD8+ T cells to the site of prostate cancer in which the CCL2 (a CCR2 ligand) expression is increased (Garetto et al., *Oncotarget*, 2016, May 10. doi: 10.18632/oncotarget.9280); and CD103 as an intestinal homing receptor.

12. Immune Signaling

Treatment with immunotherapeutic agents may induce immune cell signaling, leading to the activation of cell-type specific immune activities, ultimately resulting in an immune response. In some embodiments, payloads of the present invention may be immune signaling biomolecules used to achieve exogenous control of signaling pathways. Exemplary immune signaling biomolecules include transcription factors such as Nuclear factor of activated T-cells (NFAT) (e.g., NFAT, NFAT2, NFAT3 and NFAT 4), Nuclear Factor Kappa B (NFκB), Signal transducer and activator of transcription (STAT), Activator protein-1 (AP-1), Rel, Fos, and Jun; kinases such as Janus Kinase (JAK), Extracellullar signal-regulated kinases (ERK), Mitogen-Activated Protein Kinases (MAPK), Mammalian target of rapamycin (mTOR), Phsophoinositide-dependent kinase (PDK), Protein kinase B (PKB), IkB kinase (IKK), Calcium/Calmodulin dependent kinase (CaMK); and other signaling molecules such as Ras, Cbl, Calmodulin (CaM), Calpain, and IkkB kinase.

In one embodiment, the payloads of the present invention may be administered in conjunction with inhibitors of SHP-1 and/or SHP-2. The tyrosine-protein phosphatase SHP1 (also known as PTPN6) and SHP2 (also known as PTPN11) are involved in the Programmed Cell Death (PD1) inhibitory signaling pathway. The intracellular domain of PD1 contains an immunoreceptor tyrosine-based inhibitory motif (ITIM) and an immunoreceptor tyrosine-based switch motif (ITSM). ITSM has been shown to recruit SHP-1 and 2. This generates negative costimulatory micro clusters that induce the dephosphorylation of the proximal TCR signaling molecules, thereby resulting in suppression of T cell activation, which can lead to T cell exhaustion. In one embodiment, inhibitors of SHP-1 and 2 may include expressing dominant negative versions of the proteins in T cells, TILs or other cell types to relieve exhaustion. Such mutants can bind to the endogenous, catalytically active proteins, and inhibit their function. In one embodiment, the dominant negative mutant of SHP-1 and/or SHP-2 lack the phosphatase domain required for catalytic activity. In some embodiments, any of the dominant negative SHP-1 mutants taught Bergeron S et al. (2011). Endocrinology. 2011 December; 152(12):4581-8; Dustin J B et al. (1999) J Immunol. March 1; 162(5):2717-24; Berchtold S (1998) Mol Endocrinol. April; 12(4):556-67 and Schram et al. (2012) Am J Physiol Heart Circ Physiol. 1; 302(1):H231-43; may be useful in the invention (the contents of each of which are incorporated by reference in their entirety).

13. Oncolytic Viruses

In some embodiments, payloads of the present invention may comprise oncolytic viruses or any components of oncolytic viruses. In some embodiments, the payload may be oncolytic viruses or components that have been genetically modified oncolytic viruses for use in oncolytic virotherapy. As used herein, the term "virotherapy" refers to a therapeutic use of oncolytic viruses (replication competent viruses) to attack and destroy cancer cells. Oncolytic viruses refer to those viruses that are able to eliminate malignancies by direct targeting and killing of cancer cells within the tumor, without causing harm to normal tissues. Exemplary oncolytic viruses and genetically engineered oncolytic viruses with cancer specific tropism may include Arvoviruses, Adenoviruses, Coxsackie viruses, Herpes Simplex Viruses (HSVs), Measles, Mumps viruses, Moloney leukemia viruses, Myxovirus, Newcastle Disease Viruses, Reoviruses, Rhabdovirus, Vesticular Stomatic Viruses, and Vaccinia Viruses (VV). It may also be chimeric viruses with increased oncolytic potential such as an adeno-parvovirus chimera in U.S. Pat. No. 9,441,246. The oncolytic viruses may be modified to be less susceptible to immune suppression while more specifically targeting particular classes of cancer cells, or be modified to insert and express cancer-suppressing transgenes. Modifications to the oncolytic virus may also be made to improve replicative potential of the virus, increase viral titers, and/or enhance the range cancer cells that can be infected by the virus. Examples of modified oncolytic viruses that may be used as payload include U.S. Pat. No. 8,282,917B2, International Patent Publication NO.: WO2011070440, WO2004078206A1, WO2016144564, WO2016119052, WO2009111892; the contents of each of which are incorporated herein by reference in their entirety.

In some embodiments, payloads of the present invention may be one or more coat proteins of the viruses, inserted transgenes, other factors that can increase intratumoral virus replication and the combinations.

In some instance, two or more oncolytic viruses may also be used as payload within the same SRE or in two or more SREs to achieve synergistic killing of target cancer cells as described in International Patent Publication NO.: WO2010020056 (the contents of which are incorporated herein by reference in their entirety).

14. Genomic Editing Systems

In some embodiments, payloads of the present invention may be components of gene editing systems including a CRISPR (Clustered Regularly Interspaced Short Palindromic Repeats), CRISPR enzyme (Cas9), CRISPR-Cas9 or CRISPR system and CRISPR-CAS9 complex. It may also be other genomic editing systems, such as Zinc finger nucleases, TALEN (Transcription activator-like effector-based nucleases) and meganucleases.

Additional Features

The effector module of the present invention may further comprise a signal sequence which regulates the distribution of the payload, a cleavage and/or processing feature which facilitate cleavage of the payload from the effector module construct, a targeting and/or penetrating signal which can regulate the cellular localization of the effector module, and/or one or more linker sequences which link different components (e.g. a DD and a payload) of the effector module. In some embodiments, the effector module may further comprise of one or more additional features such as linker sequences (with specific sequences and lengths), cleavage sites, regulatory elements (that regulate expression of the protein of interest such as microRNA targeting sites), signal sequences that lead the effector module to a specific cellular or subcellular location, penetrating sequences, or tags and biomarkers for tracking the effector module.

1. Signal Sequences

In addition to the SRE (e.g., DD) and payload region, effector modules of the invention may further comprise one or more signal sequences. Signal sequences (sometimes referred to as signal peptides, targeting signals, target peptides, localization sequences, transit peptides, leader sequences or leader peptides) direct proteins (e.g., the effector module of the present invention) to their designated cellular and/or extracellular locations. Protein signal sequences play a central role in the targeting and translocation of nearly all secreted proteins and many integral membrane proteins.

A signal sequence is a short (5-30 amino acids long) peptide present at the N-terminus of the majority of newly synthesized proteins that are destined towards a particular location. Signal sequences can be recognized by signal recognition particles (SRPs) and cleaved using type I and type II signal peptide peptidases. Signal sequences derived from human proteins can be incorporated as a regulatory module of the effector module to direct the effector module to a particular cellular and/or extracellular location. These signal sequences are experimentally verified and can be cleaved (Zhang et al., *Protein Sci.* 2004, 13:2819-2824).

In some embodiments, a signal sequence may be, although not necessarily, located at the N-terminus or C-terminus of the effector module, and may be, although not necessarily, cleaved off the desired effector module to yield a "mature" payload, i.e., an immunotherapeutic agent as discussed herein.

In some examples, a signal sequence may be a secreted signal sequence derived from a naturally secreted protein, and its variant thereof. In some instances, the secreted signal sequences may be cytokine signal sequences such as, but not limited to, IL2 signal sequence comprising amino acid of SEQ ID NO. 261 (encoded by the nucleotide sequence of SEQ ID NO. 262-265), and/or p40 signal sequence comprising the amino acid sequence of SEQ ID NO. 266 (encoded by the nucleotide sequence of SEQ ID NO. 267-275).

In some instances, signal sequences directing the payload to the surface membrane of the target cell may be used. Expression of the payload on the surface of the target cell may be useful to limit the diffusion of the payload to non-target in vivo environments, thereby potentially improving the safety profile of the payloads. Additionally, the membrane presentation of the payload may allow for physiologically and qualitative signaling as well as stabilization and recycling of the payload for a longer half-life. Membrane sequences may be the endogenous signal sequence of the N terminal component of the payload. Optionally, it may be desirable to exchange this sequence for a different signal sequence. Signal sequences may be selected based on their compatibility with the secretory pathway of the cell type of interest so that the payload is presented on the surface of the T cell. In some embodiments, the signal sequence may be IgE signal sequence comprising amino acid of SEQ ID NO. 276 (encoded by the nucleotide sequence of SEQ ID NO. 277) or CD8a signal sequence comprising amino acid SEQ ID NO. 278 (encoded by the nucleotide sequence of SEQ ID NO. 279-283).

Other examples of signal sequences include, a variant may be a modified signal sequence discussed in U.S. Pat. Nos. 8,148,494, 8,258,102, 9,133,265, 9,279,007, and U.S. patent application publication NO. 2007/0141666; and International patent application publication NO. WO1993/018181; the contents of each of which are incorporated herein by reference in their entirety. In other examples, a signal sequence may be a heterogeneous signal sequence from other organisms such as virus, yeast and bacteria, which can direct an effector module to a particular cellular site, such as a nucleus (e.g., EP 1209450). Other examples may include Aspartic Protease (NSP24) signal sequences from *Trichoderma* that can increase secretion of fused protein such as enzymes (e.g., U.S. Pat. No. 8,093,016 to Cervin and Kim), bacterial lipoprotein signal sequences (e.g., PCT application publication NO. 1991/09952 to Lau and Rioux), *E. coli* enterotoxin II signal peptides (e.g., U.S. Pat. No. 6,605,697 to Kwon et al.), *E. coli* secretion signal sequence (e.g., U.S. patent publication NO. 2016/090404 to Malley et al.), a lipase signal sequence from a methylotrophic yeast (e.g., U.S. Pat. No. 8,975,041), and signal peptides for DNases derived from *Coryneform bacteria* (e.g., U.S. Pat. No. 4,965,197); the contents of each of which are incorporated herein by reference in their entirety.

Signal sequences may also include nuclear localization signals (NLSs), nuclear export signals (NESs), polarized cell tubulo-vesicular structure localization signals (See, e.g., U.S. Pat. No. 8,993,742; Cour et al., *Nucleic Acids Res.* 2003, 31(1): 393-396; the contents of each of which are incorporated herein by reference in their entirety), extracellular localization signals, signals to subcellular locations (e.g. lysosome, endoplasmic reticulum, golgi, mitochondria, plasma membrane and peroxisomes, etc.) (See, e.g., U.S. Pat. No. 7,396,811; and Negi et al., *Database,* 2015, 1-7; the contents of each of which are incorporated herein by reference in their entirety).

2. Cleavage Sites

In some embodiments, the effector module comprises a cleavage and/or processing feature. The effector module of the present invention may include at least one protein cleavage signal/site. The protein cleavage signal/site may be located at the N-terminus, the C-terminus, at any space between the N- and the C-termini such as, but not limited to, half-way between the N- and C-termini, between the N-terminus and the half-way point, between the half-way point and the C-terminus, and combinations thereof.

The effector module may include one or more cleavage signal(s)/site(s) of any proteinases. The proteinases may be a serine proteinase, a cysteine proteinase, an endopeptidase, a dipeptidase, a metalloproteinase, a glutamic proteinase, a threonine proteinase and an aspartic proteinase. In some aspects, the cleavage site may be a signal sequence of furin, actinidain, calpain-1, carboxypeptidase A, carboxypeptidase P, carboxypeptidase Y, caspase-1, caspase-2, caspase-3, caspase-4, caspase-5, caspase-6, caspase-7, caspase-8, caspase-9, caspase-10, cathepsin B, cathepsin C, cathepsin G, cathepsin H, cathepsin K, cathepsin L, cathepsin S, cathepsin V, clostripain, chymase, chymotrypsin, elastase, endoproteinase, enterokinase, factor Xa, formic acid, granzyme B, Matrix metallopeptidase-2, Matrix metallopeptidase-3, pepsin, proteinase K, SUMO protease, subtilisin, TEV protease, thermolysin, thrombin, trypsin and TAGZyme.

In one embodiment, the cleavage site is a furin cleavage site comprising the amino acid sequence SARNRQKRS (SEQ ID NO. 284, encoded by the nucleotide sequence of SEQ ID NO. 285), or a revised furin cleavage site comprising the amino acid sequence ARNRQKRS (SEQ ID NO. 286, encoded by the nucleotide sequence of SEQ ID NO. 287), or a modified furin site comprising the amino acid sequence ESRRVRRNKRSK (SEQ ID NO. 288, encoded by the nucleotide sequence of SEQ ID NO. 289-291).

3. Protein Tags

In some embodiments, the effector module of the invention may comprise a protein tag. The protein tag may be used for detecting and monitoring the process of the effector module. The effector module may include one or more tags such as an epitope tag (e.g., a FLAG or hemagglutinin (HA) tag). A large number of protein tags may be used for the present effector modules. They include, but are not limited to, self-labeling polypeptide tags (e.g., haloalkane dehalogenase (halotag2 or halotag7), ACP tag, clip tag, MCP tag, snap tag), epitope tags (e.g., FLAG, HA, His, and Myc), fluorescent tags (e.g., green fluorescent protein (GFP), red fluorescent protein (RFP), yellow fluorescent protein (YFP), and its variants), bioluminescent tags (e.g. luciferase and its variants), affinity tags (e.g., maltose-binding protein (MBP) tag, glutathione-S-transferase (GST) tag), immunogenic affinity tags (e.g., protein A/G, IRS, AU1, AU5, glu-glu, KT3, S-tag, HSV, VSV-G, Xpress and V5), and other tags (e.g., biotin (small molecule), StrepTag (StrepII), SBP, biotin carboxyl carrier protein (BCCP), eXact, CBP, CYD, HPC, CBD intein-chitin binding domain, Trx, NorpA, and NusA.

In other embodiments, a tag may also be selected from those disclosed in U.S. Pat. Nos. 8,999,897; 8,357,511; 7,094,568; 5,011,912; 4,851,341; and 4,703,004; U.S patent application publication NOs.: 2013/115635 and 2013/012687; and International application publication NO.: WO2013/091661; the contents of each of which are incorporated herein by reference in their entirety.

In some aspects, a multiplicity of protein tags, either the same or different tags, may be used; each of the tags may be located at the same N- or C-terminus, whereas in other cases these tags may be located at each terminus.

4. Targeting Peptides

In some embodiments, the effector module of the invention may further comprise a targeting and/or penetrating peptide. Small targeting and/or penetrating peptides that selectively recognize cell surface markers (e.g. receptors, trans-membrane proteins, and extra-cellular matrix molecules) can be employed to target the effector module to the desired organs, tissues or cells. Short peptides (5-50 amino acid residues) synthesized in vitro and naturally occurring peptides, or analogs, variants, derivatives thereof, may be incorporated into the effector module for homing the effector module to the desired organs, tissues and cells, and/or subcellular locations inside the cells.

In some embodiments, a targeting sequence and/or penetrating peptide may be included in the effector module to drive the effector module to a target organ, or a tissue, or a cell (e.g., a cancer cell). In other embodiments, a targeting and/or penetrating peptide may direct the effector module to a specific subcellular location inside a cell.

A targeting peptide has any number of amino acids from about 6 to about 30 inclusive. The peptide may have 6, 7, 8, 9, 10, 11, 12, 13, 14, 15, 16, 17, 18, 19, 20, 21, 22, 23, 24, 25, 26, 27, 28, 29 or 30 amino acids. Generally, a targeting peptide may have 25 or fewer amino acids, for example, 20 or fewer, for example 15 or fewer.

Exemplary targeting peptides may include, but are not limited to, those disclosed in the art, e.g., U.S. Pat. Nos. 9,206,231, 9,110,059, 8,706,219; and 8,772,449, and U.S. application publication NOs. 2016/089447. 2016/060296. 2016/060314. 2016/060312. 2016/060311. 2016/009772. 2016/002613. 2015/314011 and 2015/166621. and International application publication NOs. WO2015/179691 and WO2015/183044; the contents of each of which are incorporated herein by reference in their entirety.

5. Linkers

In some embodiments, the effector module of the invention may further comprise a linker sequence. The linker region serves primarily as a spacer between two or more polypeptides within the effector module. A "linker" or "spacer", as used herein, refers to a molecule or group of molecules that connects two molecules, or two parts of a molecule such as two domains of a recombinant protein.

In some embodiments, "Linker" (L) or "linker domain" or "linker region" or "linker module" or "peptide linker" as used herein refers to an oligo- or polypeptide region of from about 1 to 100 amino acids in length, which links together any of the domains/regions of the effector module (also called peptide linker). The peptide linker may be 1-40 amino acids in length, or 2-30 amino acids in length, or 20-80 amino acids in length, or 50-100 amino acids in length. Linker length may also be optimized depending on the type of payload utilized and based on the crystal structure of the payload. In some instances, a shorter linker length may be preferably selected. In some aspects, the peptide linker is made up of amino acids linked together by peptide bonds, preferably from 1 to 20 amino acids linked by peptide bonds, wherein the amino acids are selected from the 20 naturally occurring amino acids: Glycine (G), Alanine (A), Valine (V), Leucine (L), Isoleucine (I), Serine (S), Cysteine (C), Threonine (T), Methionine (M), Proline (P), Phenylalanine (F), Tyrosine (Y), Tryptophan (W), Histidine (H), Lysine (K), Arginine (R), Aspartate (D), Glutamic acid (E), Asparagine (N), and Glutamine (Q). One or more of these amino acids may be glycosylated, as is understood by those in the art. In some aspects, amino acids of a peptide linker may be selected from Alanine (A), Glycine (G), Proline (P), Asparagine (R), Serine (S), Glutamine (Q) and Lysine (K).

In one example, an artificially designed peptide linker may preferably be composed of a polymer of flexible residues like Glycine (G) and Serine (S) so that the adjacent protein domains are free to move relative to one another. Longer linkers may be used when it is desirable to ensure that two adjacent domains do not interfere with one another. The choice of a particular linker sequence may concern if it affects biological activity, stability, folding, targeting and/or pharmacokinetic features of the fusion construct. Examples of peptide linkers include, but are not limited to: SG, MH, GGSG (SEQ ID NO. 292, encoded by the nucleotide sequence of SEQ ID NO. 293; GGSGG (SEQ ID NO. 294), encoded by the nucleotide sequence of SEQ ID NOs. 295-299; GGSGGG (SEQ ID NO. 78), encoded by the nucleotide sequence of SEQ ID NO. 93 and 300; SGGGS (SEQ ID NO. 301), encoded by the nucleotide sequence of SEQ ID NO. 302-303; GGSGGGSGG (SEQ ID NO. 77), encoded by the nucleotide sequence of SEQ ID NO. 92; GGGGG (SEQ ID NO. 304), GGGGS (SEQ ID NO. 305) or (GGGGS)n (n=2 (SEQ ID NO. 306), 3 (SEQ ID NO. 307; encoded by SEQ ID NO. 308-313), 4 (SEQ ID NO. 314), 5 (SEQ ID NO. 315), or 6 (SEQ ID NO. 316)), SSSSG (SEQ ID NO. 317) or (SSSSG)n (n=2 (SEQ ID NO. 318), 3 (SEQ ID NO. 319), 4 (SEQ ID NO. 320), 5 (SEQ ID NO. 321), or 6 (SEQ ID NO. 322)), SGGGSGGGGSGGGGSGGGGSGGGSLQ (SEQ ID NO. 323), encoded by the nucleotide sequence of SEQ ID NO. 324; EFSTEF (SEQ ID NO. 325), encoded by the nucleotide sequence of SEQ ID NOs. 326-327; GKSSGSGSESKS (SEQ ID NO. 328), GGSTSGSGKSSEGKG (SEQ ID NO. 329), GSTSGSGKSSSEGSGSTKG (SEQ ID NO. 330), GSTSGSGKPGSGEGSTKG (SEQ ID NO. 331), VDYPYDVPDYALD (SEQ ID NO. 332), encoded by the nucleotide sequence of SEQ ID NO. 333; or EGKSSGSGSESKEF (SEQ ID NO. 334); or GSGSGS (SEQ ID NO. 8330), encoded by the nucleotide sequence of SEQ ID NO. 8347; or GSGSGSGS (SEQ ID NO. 8331), encoded by the nucleotide sequence of SEQ ID NO. 8348; or GSGSGGGSGS (SEQ ID NO. 8332), encoded by the nucleotide sequence of SEQ ID NO. 8349; SGSGSGS linker (SEQ ID NO: 8382), or SG linker, encoded by AGTGGT; or an LD Linker comprising Lysine Aspartic acid, encoded by CTAGAT. Linkers may also be DNA restriction enzyme recognition sites or modifications thereof such as flexible GS or G/S rich linker; BamH1 Site encoded by GGATCC; flexible G/S rich linker or BamH1 Site; SR/Xba I site, encoded by TCTAGA; or a GSG linker (BamH1-Gly) linker, encoded by GGATCCGGA.

In other examples, a peptide linker may be made up of a majority of amino acids that are sterically unhindered, such as Glycine (G) and Alanine (A). Exemplary linkers are polyglycines (such as $(G)_4$ (SEQ ID NO: 8378), $(G)_5$ (SEQ ID NO: 8379), $(G)_5$ (SEQ ID NO: 8380)), poly(GA), and polyalanines. The linkers described herein are exemplary, and linkers that are much longer and which include other residues are contemplated by the present invention.

A linker sequence may be a natural linker derived from a multi-domain protein. A natural linker is a short peptide sequence that separates two different domains or motifs within a protein.

In some aspects, linkers may be flexible or rigid. In other aspects, linkers may be cleavable or non-cleavable. As used herein, the terms "cleavable linker domain or region" or "cleavable peptide linker" are used interchangeably. In some embodiments, the linker sequence may be cleaved enzymatically and/or chemically. Examples of enzymes (e.g., proteinase/peptidase) useful for cleaving the peptide linker include, but are not limited to, Arg-C proteinase, Asp-N endopeptidase, chymotrypsin, clostripain, enterokinase, Factor Xa, glutamyl endopeptidase, Granzyme B, Achromobacter proteinase I, pepsin, proline endopeptidase, proteinase K, Staphylococcal peptidase I, thermolysin, thrombin, trypsin, and members of the Caspase family of proteolytic enzymes (e.g. Caspases 1-10). Chemical sensitive cleavage sites may also be included in a linker sequence. Examples of chemical cleavage reagents include, but are not limited to, cyanogen bromide, which cleaves methionine residues; N-chloro succinimide, iodobenzoic acid or BNPS-skatole [2-(2-nitrophenylsulfenyl)-3-methylindole], which cleaves tryptophan residues; dilute acids, which cleave at aspartyl-prolyl bonds; and e aspartic acid-proline acid cleavable recognition sites (i.e., a cleavable peptide linker comprising one or more D-P dipeptide moieties). The fusion module may include multiple regions encoding peptides of interest separated by one or more cleavable peptide linkers.

In other embodiments, a cleavable linker may be a "self-cleaving" linker peptide, such as 2A linkers (for example T2A), 2A-like linkers or functional equivalents thereof and combinations thereof. In some embodiments, the linkers include the picornaviral 2A-like linker, CHYSEL sequences of porcine teschovirus (P2A), Thosea asigna virus (T2A) or combinations, variants and functional equivalents thereof. In some embodiments, the biocircuits of the present invention may include 2A peptides. The 2A peptide is a sequence of about 20 amino acid residues from a virus that is recognized by a protease (2A peptidases) endogenous to the cell. The 2A peptide was identified among picornaviruses, a typical example of which is the Foot-and Mouth disease virus (Robertson B H, et. al., J Virol 1985, 54:651-660). 2A-like sequences have also been found in Picornaviridae like equine rhinitis A virus, as well as unrelated viruses such as porcine teschovirus-1 and the insect Thosea asigna virus (TaV). In such viruses, multiple proteins are derived from a large polyprotein encoded by an open reading frame. The 2A peptide mediates the co-translational cleavage of this polyprotein at a single site that forms the junction between the virus capsid and replication polyprotein domains. The 2A sequences contain the consensus motif D-V/I-E-X-N-P-G-P (SEQ ID NO: 8381). These sequences are thought to act co-translationally, preventing the formation of a normal peptide bond between the glycine and last proline, resulting in the ribosome skipping of the next codon (Donnelly M L et al. (2001). J Gen Virol, 82:1013-1025). After cleavage, the short peptide remains fused to the C-terminus of the protein upstream of the cleavage site, while the proline is added to the N-terminus of the protein downstream of the cleavage site. Of the 2A peptides identified, four have been widely used namely FMDV 2A (abbreviated herein as F2A); equine rhinitis A virus (ERAV) 2A (E2A); porcine teschovirus-1 2A (P2A) and Thoseaasigna virus 2A (T2A). In some embodiments, the 2A peptide sequences useful in the present invention are selected from SEQ ID NO.8-11 of International Patent Publication WO2010042490, the contents of which are incorporated by reference in its entirety. In some embodiments, the cleavage site may be a P2A cleavable peptide (SEQ ID NO. 8239), encoded by the nucleotide sequence of SEQ ID NO. 8269.

Other linkers will be apparent to those skilled in the art and may be used in connection with alternate embodiments of the invention.

The linkers of the present invention may also be non-peptide linkers. For example, alkyl linkers such as —NH—

(CH$_2$) a-C(O)—, wherein a=2-20 can be used. These alkyl linkers may further be substituted by any non-sterically hindering group such as lower alkyl (e.g., C$_1$-C$_6$) lower acyl, halogen (e.g., Cl, Br), CN, NH$_2$, phenyl, etc.

In some aspects, the linker may be an artificial linker from U.S. Pat. Nos. 4,946,778, 5,525,491, 5,856,456, and International patent publication NO. WO2012/083424; the contents of each of which are incorporated herein by reference in their entirety.

6. Embedded Stimulus, Signals and Other Regulatory Features microRNAs (or miRNA) are 19-25 nucleotide long noncoding RNAs that bind to the 3'UTR of nucleic acid molecules and down-regulate gene expression either by reducing nucleic acid molecule stability or by inhibiting translation. The polynucleotides of the invention may comprise one or more microRNA target sequences, microRNA sequences, or microRNA seeds. Such sequences may correspond to any known microRNA such as those taught in US Publication No. US2005/0261218 and US Publication No. US2005/0059005, the contents of which are incorporated herein by reference in their entirety. As a non-limiting embodiment, known microRNAs, their sequences and their binding site sequences in the human genome are listed Table 14 of the co-owned U.S. Provisional Patent Application No. 62/320,864 filed Apr. 11, 2016, 62/466,596 filed Mar. 3, 2017 and the International Publication WO2017/180587 (the contents of each of which are herein incorporated by reference in their entirety).

A microRNA sequence comprises a "seed" region, i.e., a sequence in the region of positions 2-8 of the mature microRNA, which sequence has perfect Watson-Crick complementarity to the miRNA target sequence. A microRNA seed may comprise positions 2-8 or 2-7 of the mature microRNA. In some embodiments, a microRNA seed may comprise 7 nucleotides (e.g., nucleotides 2-8 of the mature microRNA), wherein the seed-complementary site in the corresponding miRNA target is flanked by an adenine (A) opposed to microRNA position 1. In some embodiments, a microRNA seed may comprise 6 nucleotides (e.g., nucleotides 2-7 of the mature microRNA), wherein the seed-complementary site in the corresponding miRNA target is flanked by an adenine (A) opposed to microRNA position 1. See for example, Grimson A, Farh K K, Johnston W K, Garrett-Engele P, Lim L P, Bartel D P; Mol Cell. 2007 Jul. 6; 27(1):91-105. The bases of the microRNA seed have complete complementarity with the target sequence. By engineering microRNA target sequences into the polynucleotides encoding the biocircuit components, effector modules, SREs or payloads of the invention one can target the molecule for degradation or reduced translation, provided the microRNA in question is available. This process will reduce the hazard of off target effects upon nucleic acid molecule delivery.

Identification of microRNA, microRNA target regions, and their expression patterns and role in biology have been reported (Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136: 215-233; Landgraf et al, Cell, 2007 129:1401-1414; Gentner and Naldini, Tissue Antigens. 2012 80:393-403 and all references therein; each of which is herein incorporated by reference in its entirety).

For example, if the polynucleotide is not intended to be delivered to the liver but ends up there, then miR-122, a microRNA abundant in liver, can inhibit the expression of the polynucleotide if one or multiple target sites of miR-122 are engineered into the polynucleotide. Introduction of one or multiple binding sites for different microRNA can be engineered to further decrease the longevity, stability, and protein translation of a polynucleotide hence providing an additional layer of tenability beyond the stimulus selection, SRE design and payload variation.

As used herein, the term "microRNA site" refers to a microRNA target site or a microRNA recognition site, or any nucleotide sequence to which a microRNA binds or associates. It should be understood that "binding" may follow traditional Watson-Crick hybridization rules or may reflect any stable association of the microRNA with the target sequence at or adjacent to the microRNA site.

Conversely, for the purposes of the polynucleotides of the present invention, microRNA binding sites can be engineered out of (i.e. removed from) sequences in which they naturally occur in order to increase protein expression in specific tissues. For example, miR-122 binding sites may be removed to improve protein expression in the liver.

Regulation of expression in multiple tissues can be accomplished through introduction or removal or one or several microRNA binding sites.

Specifically, microRNAs are known to be differentially expressed in immune cells (also called hematopoietic cells), such as antigen presenting cells (APCs) (e.g. dendritic cells and macrophages), macrophages, monocytes, B lymphocytes, T lymphocytes, granulocytes, natural killer cells, etc. Immune cell specific microRNAs are involved in immunogenicity, autoimmunity, the immune-response to infection, inflammation, as well as unwanted immune response after gene therapy and tissue/organ transplantation. Immune cells specific microRNAs also regulate many aspects of development, proliferation, differentiation and apoptosis of hematopoietic cells (immune cells). For example, miR-142 and miR-146 are exclusively expressed in the immune cells, particularly abundant in myeloid dendritic cells. Introducing the miR-142 binding site into the 3'-UTR of a polypeptide of the present invention can selectively suppress the gene expression in the antigen presenting cells through miR-142 mediated mRNA degradation, limiting antigen presentation in professional APCs (e.g. dendritic cells) and thereby preventing antigen-mediated immune response after gene delivery (see, Annoni A et al., blood, 2009, 114, 5152-5161, the content of which is herein incorporated by reference in its entirety.)

In one embodiment, microRNAs binding sites that are known to be expressed in immune cells, in particular, the antigen presenting cells, can be engineered into the polynucleotides to suppress the expression of the polynucleotide in APCs through microRNA mediated RNA degradation, subduing the antigen-mediated immune response, while the expression of the polynucleotide is maintained in non-immune cells where the immune cell specific microRNAs are not expressed.

Many microRNA expression studies have been conducted, and are described in the art, to profile the differential expression of microRNAs in various cancer cells/tissues and other diseases. Some microRNAs are abnormally over-expressed in certain cancer cells and others are under-expressed. For example, microRNAs are differentially expressed in cancer cells (WO2008/154098, US2013/0059015, US2013/0042333, WO2011/157294); cancer stem cells (US2012/0053224); pancreatic cancers and diseases (US2009/0131348, US2011/0171646, US2010/0286232, U.S. Pat. No. 8,389,210); asthma and inflammation (U.S. Pat. No. 8,415,096); prostate cancer (US2013/0053264);

hepatocellular carcinoma (WO2012/151212, US2012/0329672, WO2008/054828, U.S. Pat. No. 8,252,538); lung cancer cells (WO2011/076143, WO2013/033640, WO2009/070653, US2010/0323357); cutaneous T cell lymphoma (WO2013/011378); colorectal cancer cells (WO2011/0281756, WO2011/076142); cancer positive lymph nodes (WO2009/100430, US2009/0263803); nasopharyngeal carcinoma (EP2112235); chronic obstructive pulmonary disease (US2012/0264626, US2013/0053263); thyroid cancer (WO2013/066678); ovarian cancer cells (US2012/0309645, WO2011/095623); breast cancer cells (WO2008/154098, WO2007/081740, US2012/0214699), leukemia and lymphoma (WO2008/073915, US2009/0092974, US2012/0316081, US2012/0283310, WO2010/018563, the content of each of which is incorporated herein by reference in their entirety).

In one embodiment, microRNA may be used as described herein in support of the creation of tunable biocircuits.

In some embodiments, effector modules may be designed to encode (as a DNA or RNA or mRNA) one or more payloads, SREs and/or regulatory sequence such as a microRNA or microRNA binding site. In some embodiments, any of the encoded payloads or SREs may be stabilized or de-stabilized by mutation and then combined with one or more regulatory sequences to generate a dual or multi-tuned effector module or biocircuit system.

Each aspect or tuned modality may bring to the effector module or biocircuit a differentially tuned feature. For example, an SRE may represent a destabilizing domain, while mutations in the protein payload may alter its cleavage sites or dimerization properties or half-life and the inclusion of one or more microRNA or microRNA binding site may impart cellular detargeting or trafficking features. Consequently, the present invention embraces biocircuits which are multifactorial in their tenability.

In some embodiments, compositions of the invention may include optional proteasome adaptors. As used herein, the term "proteasome adaptor" refers to any nucleotide/amino acid sequence that targets the appended payload for degradation. In some aspects, the adaptors target the payload for degradation directly thereby circumventing the need for ubiquitination reactions. Proteasome adaptors may be used in conjunction with destabilizing domains to reduce the basal expression of the payload. Exemplary proteasome adaptors include the UbL domain of Rad23 or hHR23b, HPV E7 which binds to both the target protein Rb and the S4 subunit of the proteasome with high affinity, which allows direct proteasome targeting, bypassing the ubiquitination machinery; the protein gankyrin which binds to Rb and the proteasome subunit S6.

Such biocircuits may be engineered to contain one, two, three, four or more tuned features.

Polynucleotides

The present invention provides polynucleotides encoding novel hPDE5 DDs, effector modules comprising payloads and associated DDs, biocircuit systems comprising DDs and effector modules, and other components of the present invention.

The invention provides isolated biocircuit polypeptides, effector modules, stimulus response elements (SREs) and payloads, as well as polynucleotides encoding any of the foregoing; vectors comprising polynucleotides of the invention; and cells expressing polypeptides, polynucleotides and vectors of the invention. The polypeptides, polynucleotides, viral vectors and cells are useful for inducing anti-tumor immune responses in a subject.

The term "polynucleotide" or "nucleic acid molecule" in its broadest sense, includes any compound and/or substance that comprise a polymer of nucleotides, e.g., linked nucleosides. These polymers are often referred to as polynucleotides. Exemplary nucleic acids or polynucleotides of the invention include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization) or hybrids thereof.

In some embodiments, polynucleotides of the invention may be a messenger RNA (mRNA) or any nucleic acid molecule and may or may not be chemically modified. In one aspect, the nucleic acid molecule is a mRNA. As used herein, the term "messenger RNA (mRNA)" refers to any polynucleotide which encodes a polypeptide of interest and which is capable of being translated to produce the encoded polypeptide of interest in vitro, in vivo, in situ or ex vivo.

Traditionally, the basic components of an mRNA molecule include at least a coding region, a 5'UTR, a 3'UTR, a 5' cap and a poly-A tail. Building on this wild type modular structure, the present invention expands the scope of functionality of traditional mRNA molecules by providing payload constructs which maintain a modular organization, but which comprise one or more structural and/or chemical modifications or alterations which impart useful properties to the polynucleotide, for example tenability of function. As used herein, a "structural" feature or modification is one in which two or more linked nucleosides are inserted, deleted, duplicated, inverted or randomized in a polynucleotide without significant chemical modification to the nucleosides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" may be chemically modified to "AT-5meC-G". The same polynucleotide may be structurally modified from "ATCG" to "ATCCCG". Here, the dinucleotide "CC" has been inserted, resulting in a structural modification to the polynucleotide.

In some embodiments, polynucleotides of the present invention may harbor 5'UTR sequences which play a role in translation initiation. 5'UTR sequences may include features such as Kozak sequences which are commonly known to be involved in the process by which the ribosome initiates translation of genes, Kozak sequences have the consensus XCCR(A/G) CCAUG, where R is a purine (adenine or guanine) three bases upstream of the start codon (AUG) and X is any nucleotide. In one embodiment, the Kozak sequence is ACCGCC. By engineering the features that are typically found in abundantly expressed genes of target cells or tissues, the stability and protein production of the polynucleotides of the invention can be enhanced.

Further provided are polynucleotides, which may contain an internal ribosome entry site (IRES) which play an important role in initiating protein synthesis in the absence of 5' cap structure in the polynucleotide. An IRES may act as the sole ribosome binding site, or may serve as one of the multiple binding sites. Polynucleotides of the invention containing more than one functional ribosome binding site may encode several peptides or polypeptides that are translated independently by the ribosomes giving rise to bicistronic and/or multicistronic nucleic acid molecules.

In some embodiments, polynucleotides encoding biocircuits, effector modules, DDs and payloads may include from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000 nucleotides). In some aspects, polynucleotides of the invention may include more than 10,000 nucleotides.

Regions of the polynucleotides which encode certain features such as cleavage sites, linkers, trafficking signals, tags or other features may range independently from 10-1,000 nucleotides in length (e.g., greater than 20, 30, 40, 45, 50, 55, 60, 70, 80, 90, 100, 120, 140, 160, 180, 200, 250, 300, 350, 400, 450, 500, 600, 700, 800, and 900 nucleotides or at least 10, 15, 20, 25, 30, 35, 40, 45, 50, 55, 60, 70, 80, 90, 100, 120, 140, 160, 180, 200, 250, 300, 350, 400, 450, 500, 600, 700, 800, 900, and 1,000 nucleotides).

In some embodiments, polynucleotides of the present invention may further comprise embedded regulatory moieties such as microRNA binding sites within the 3'UTR of nucleic acid molecules which when bind to microRNA molecules, down-regulate gene expression either by reducing nucleic acid molecule stability or by inhibiting translation. Conversely, for the purposes of the polynucleotides of the present invention, microRNA binding sites can be engineered out of (i.e. removed from) sequences in which they naturally occur in order to increase protein expression in specific tissues. For example, miR-142 and miR-146 binding sites may be removed to improve protein expression in the immune cells. In some embodiments, any of the encoded payloads may be may be regulated by an SRE and then combined with one or more regulatory sequences to generate a dual or multi-tuned effector module or biocircuit system.

In some embodiments, polynucleotides of the present invention may encode fragments, variants, derivatives of polypeptides of the inventions. In some aspects, the variant sequence may keep the same or a similar activity. Alternatively, the variant may have an altered activity (e.g., increased or decreased) relative to the start sequence. Generally, variants of a particular polynucleotide or polypeptide of the invention will have at least about 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen et al., Gapped BLAST and PSI-BLAST: a new generation of protein database search programs, *Nucleic Acids Res.*, 1997, 25:3389-3402.)

In some embodiments, polynucleotides of the present invention may be modified. As used herein, the terms "modified", or as appropriate, "modification" refers to chemical modification with respect to A, G, U (T in DNA) or C nucleotides. Modifications may be on the nucleoside base and/or sugar portion of the nucleosides which comprise the polynucleotide. In some embodiments, multiple modifications are included in the modified nucleic acid or in one or more individual nucleoside or nucleotide. For example, modifications to a nucleoside may include one or more modifications to the nucleobase and the sugar. Modifications to the polynucleotides of the present invention may include any of those taught in, for example, International Publication NO. WO2013/052523, the contents of which are incorporated herein by reference in its entirety.

As described herein "nucleoside" is defined as a compound containing a sugar molecule (e.g., a pentose or ribose) or a derivative thereof in combination with an organic base (e.g., a purine or pyrimidine) or a derivative thereof (also referred to herein as "nucleobase"). As described herein, "nucleotide" is defined as a nucleoside including a phosphate group.

In some embodiments, the modification may be on the internucleoside linkage (e.g., phosphate backbone). Herein, in the context of the polynucleotide backbone, the phrases "phosphate" and "phosphodiester" are used interchangeably. Backbone phosphate groups can be modified by replacing one or more of the oxygen atoms with a different substituent. Further, the modified nucleosides and nucleotides can include the wholesale replacement of an unmodified phosphate moiety with another internucleoside linkage. Examples of modified phosphate groups include, but are not limited to, phosphorothioate, phosphoroselenates, boranophosphates, boranophosphate esters, hydrogen phosphonates, phosphoramidates, phosphorodiamidates, alkyl or aryl phosphonates, and phosphotriesters. Phosphorodithioates have both non-linking oxygens replaced by sulfur. The phosphate linker can also be modified by the replacement of a linking oxygen with nitrogen (bridged phosphoramidates), sulfur (bridged phosphorothioates), and carbon (bridged methylene-phosphonates). Other modifications which may be used are taught in, for example, International Application NO.: WO2013/052523, the contents of which are incorporated herein by reference in their entirety.

Chemical modifications and/or substitution of the nucleotides or nucleobases of the polynucleotides of the invention which are useful in the present invention include any modified substitutes known in the art, for example, (±)1-(2-Hydroxypropyl)pseudouridine TP, (2R)-1-(2-Hydroxypropyl)pseudouridine TP, 1-(4-Methoxy-phenyl)pseudo-UTP, 2'-O-dimethyladenosine, 1,2'-O-dimethylguanosine, 1,2'-O-dimethylinosine, 1-Hexyl-pseudo-UTP, 1-Homoallylpseudouridine TP, 1-Hydroxymethylpseudouridine TP, 1-isopropyl-pseudo-UTP, 1-Me-2-thio-pseudo-UTP, 1-Me-4-thio-pseudo-UTP, 1-Me-alpha-thio-pseudo-UTP, 1-Me-GTP, 2'-Amino-2'-deoxy-ATP, 2'-Amino-2'-deoxy-CTP, 2'-Amino-2'-deoxy-GTP, 2'-Amino-2'-deoxy-UTP, 2'-Azido-2'-deoxy-ATP, tubercidine, undermodified hydroxywybutosine, uridine 5-oxyacetic acid, uridine 5-oxyacetic acid methyl ester, wybutosine, wyosine, xanthine, Xanthosine-5'-TP, xylo-adenosine, zebularine, α-thio-adenosine, α-thio-cytidine, α-thio-guanosine, and/or α-thio-uridine.

Polynucleotides of the present invention may comprise one or more of the modifications taught herein. Different sugar modifications, base modifications, nucleotide modifications, and/or internucleoside linkages (e.g., backbone structures) may exist at various positions in the polynucleotide of the invention. One of ordinary skill in the art will appreciate that the nucleotide analogs or other modification(s) may be located at any position(s) of a polynucleotide such that the function of the polynucleotide is not substantially decreased. A modification may also be a 5' or 3' terminal modification. The polynucleotide may contain from about 1% to about 100% modified nucleotides (either in relation to overall nucleotide content, or in relation to one or more types of nucleotide, i.e. any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100%).

In some embodiments, one or more codons of the polynucleotides of the present invention may be replaced with other codons encoding the native amino acid sequence to tune the expression of the SREs, through a process referred to as codon selection. Since mRNA codon, and tRNA anticodon pools tend to vary among organisms, cell types, sub cellular locations and over time, the codon selection described herein is a spatiotemporal (ST) codon selection.

In some embodiments of the invention, certain polynucleotide features may be codon optimized. Codon optimization refers to a process of modifying a nucleic acid sequence for enhanced expression in the host cell by replacing at least 1, 2, 3, 4, 5, 10, 15, 20, 25, 50 or more codons of the native sequence with codons that are most frequently used in the genes of that host cell while maintaining the native amino acid sequence. Codon usage may be measured using the Codon Adaptation Index (CAI) which measures the deviation of a coding polynucleotide sequence from a reference gene set. Codon usage tables are available at the Codon Usage Database (www.kazusa.or.jp/codon/) and the CAI can be calculated by EMBOSS CAI program (emboss.sourceforge.net/). Codon optimization methods are known in the art and may be useful in efforts to achieve one or more of several goals. These goals include to match codon frequencies in target and host organisms to ensure proper folding, bias nucleotide content to alter stability or reduce secondary structures, minimize tandem repeat codons or base runs that may impair gene construction or expression, customize transcriptional and translational control regions, insert or remove protein signaling sequences, remove/add post translation modification sites in encoded protein (e.g. glycosylation sites), add, remove or shuffle protein domains, insert or delete restriction sites, modify ribosome binding sites and degradation sites, to adjust translational rates to allow the various domains of the protein to fold properly, or to reduce or eliminate problem secondary structures within the polynucleotide. Codon optimization tools, algorithms and services are known in the art, and non-limiting examples include services from GeneArt (Life Technologies), DNA2.0 (Menlo Park Calif.), OptimumGene (GenScript, Piscataway, N.J.), algorithms such as but not limited to, DNAWorks v3.2.3, and/or proprietary methods. In one embodiment, a polynucleotide sequence or portion thereof is codon optimized using optimization algorithms. Codon options for each amino acid are well-known in the art as are various species table for optimizing for expression in that particular species.

In some embodiments of the invention, certain polynucleotide features may be codon optimized. For example, a preferred region for codon optimization may be upstream (5') or downstream (3') to a region which encodes a polypeptide. These regions may be incorporated into the polynucleotide before and/or after codon optimization of the payload encoding region or open reading frame (ORF).

After optimization (if desired), the polynucleotide components are reconstituted and transformed into a vector such as, but not limited to, plasmids, viruses, cosmids, and artificial chromosomes.

Spatiotemporal codon selection may impact the expression of the polynucleotides of the invention, since codon composition determines the rate of translation of the mRNA species and its stability. For example, tRNA anticodons to optimized codons are abundant, and thus translation may be enhanced. In contrast, tRNA anticodons to less common codons are fewer and thus translation may proceed at a slower rate. Presnyak et al. have shown that the stability of an mRNA species is dependent on the codon content, and higher stability and thus higher protein expression may be achieved by utilizing optimized codons (Presnyak et al. (2015) Cell 160, 1111-1124; the contents of which are incorporated herein by reference in their entirety). Thus, in some embodiments, ST codon selection may include the selection of optimized codons to enhance the expression of the SRES, effector modules and biocircuits of the invention. In other embodiments, spatiotemporal codon selection may involve the selection of codons that are less commonly used in the genes of the host cell to decrease the expression of the compositions of the invention. The ratio of optimized codons to codons less commonly used in the genes of the host cell may also be varied to tune expression.

In some embodiments, certain regions of the polynucleotide may be modified using codon selection methods. For example, a preferred region for codon selection may be upstream (5') or downstream (3') to a region which encodes a polypeptide. These regions may be incorporated into the polynucleotide before and/or after codon selection of the payload encoding region or open reading frame (ORF).

The stop codon of the polynucleotides of the present invention may be modified to include sequences and motifs to alter the expression levels of the SREs, payloads and effector modules of the present invention. Such sequences may be incorporated to induce stop codon readthrough, wherein the stop codon may specify amino acids e.g. selenocysteine or pyrrolysine. In other instances, stop codons may be skipped altogether to resume translation through an alternate open reading frame. Stop codon read through may be utilized to tune the expression of components of the effector modules at a specific ratio (e.g. as dictated by the stop codon context). Examples of preferred stop codon motifs include UGAN, UAAN, and UAGN, where N is either C or U.

Polynucleotide modifications and manipulations can be accomplished by methods known in the art such as, but not limited to, site directed mutagenesis and recombinant technology. The resulting modified molecules may then be tested for activity using in vitro or in vivo assays such as those described herein or any other suitable screening assay known in the art.

In some embodiments, polynucleotides of the invention may comprise two or more effector module sequences, or two or more payload sequences, which are in a pattern such as ABABAB or AABBAABBAABB or ABCABCABC or variants thereof repeated once, twice, or more than three times. In these patterns, each letter, A, B, or C represent a different effector module component.

In yet another embodiment, polynucleotides of the invention may comprise two or more effector module component sequences with each component having one or more SRE sequences (DD sequences), or two or more payload sequences. As a non-limiting example, the sequences may be in a pattern such as ABABAB or AABBAABBAABB or ABCABCABC or variants thereof repeated once, twice, or more than three times in each of the regions. As another non-limiting example, the sequences may be in a pattern such as ABABAB or AABBAABBAABB or ABCABCABC or variants thereof repeated once, twice, or more than three times across the entire polynucleotide. In these patterns, each letter, A, B, or C represent a different sequence or component.

According to the present invention, polynucleotides encoding distinct biocircuits, effector modules, SREs and payload constructs may be linked together through the 3'-end using nucleotides which are modified at the 3'-terminus. Chemical conjugation may be used to control the stoichiometry of delivery into cells. Polynucleotides can be designed to be conjugated to other polynucleotides, dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases, proteins, e.g., glycoproteins, or peptides, e.g., molecules having a specific affinity for a co-ligand, or antibodies e.g., an antibody, that binds to a specified cell type such as a cancer cell, endothelial cell, or bone cell, hormones and hormone receptors, non-peptidic species, such as lipids, lectins, carbohydrates, vitamins, cofactors, or a drug. As non-limiting examples, they may be conjugates with other immune conjugates.

In some embodiments, the compositions of the polynucleotides of the invention may generated by combining the various components of the effector modules using the Gibson assembly method. The Gibson assembly reaction consists of three isothermal reactions, each relying on a different enzymatic activity including a 5' exonuclease which generates long overhangs, a polymerase which fills in the gaps of the annealed single strand regions and a DNA ligase which seals the nicks of the annealed and filled-in gaps. Polymerase chain reactions are performed prior to Gibson assembly which may be used to generate PCR products with overlapping sequence. These methods can be repeated sequentially, to assemble larger and larger molecules. For example, the method can comprise repeating a method as above to join a second set of two or more DNA molecules of interest to one another, and then repeating the method again to join the first and second set DNA molecules of interest, and so on. At any stage during these multiple rounds of assembly, the assembled DNA can be amplified by transforming it into a suitable microorganism, or it can be amplified in vitro (e.g., with PCR).

In some embodiments, polynucleotides of the invention may encode effector modules comprising a destabilizing domain (DD) and at least one payload taught herein. The DD domain may be a hPDE5 mutant comprising one, two, three, four, five or more mutations In some embodiments, the effector module may be a PDE5-GFP fusion encoded by SEQ ID NO. 95-106; 205-222; 234-236; 256-260; 378-379; 469-503; and 526-533. In some embodiments, the effector module may be hPDE5-CAR constructs, encoded by SEQ ID NO. 8285-8298 or a hPDE5-IL15-IL15Ra constructs, encoded by SEQ ID NO. 8352-8361.

Cells

In accordance with the present invention, cells genetically modified to express at least one biocircuit, SRE (e. g, DD), effector module and immunotherapeutic agent of the invention, are provided. Cells of the invention may include, without limitation, immune cells, stem cells and tumor cells. In some embodiments, immune cells are immune effector cells, including, but not limiting to, T cells such as CD8$^+$ T cells and CD4$^+$ T cells (e.g., Th1, Th2, Th17, Foxp3+ cells), memory T cells such as T memory stem cells, central T memory cells, and effector memory T cells, terminally differentiated effector T cells, natural killer (NK) cells, NK T cells, tumor infiltrating lymphocytes (TILs), cytotoxic T lymphocytes (CTLs), regulatory T cells (Tregs), and dendritic cells (DCs), other immune cells that can elicit an effector function, or the mixture thereof. T cells may be Tαβ cells and Tγδ cells. In some embodiments, stem cells may be from human embryonic stem cells, mesenchymal stem cells, and neural stem cells. In some embodiments, T cells may be depleted endogenous T cell receptors (See U.S. Pat. Nos. 9,273,283; 9,181,527; and 9,028,812; the contents of each of which are incorporated herein by reference in their entirety).

In some embodiments, cells of the invention may be autologous, allogeneic, syngeneic, or xenogeneic in relation to a particular individual subject.

In some embodiments, cells of the invention may be mammalian cells, particularly human cells. Cells of the invention may be primary cells or immortalized cell lines.

In some embodiments, cells of the invention may include expansion factors as payload to trigger proliferation and expansion of the cells. Exemplary payloads include RAS such as KRAS, NRAS, RRAS, RRAS2, MRAS, ERAS, and HRAS, DIRAS such as DIRAS1, DIRAS2, and DIRAS3, NKIRAS such as NKIRAS1, and NKIRAS2, RAL such as RALA, and RALB, RAP such as RAP1A, RAP1B, RAP2A, RAP2B, and RAP2C, RASD such as RASD1, and RASD2, RASL such as RASL10A, RASL10B, RASL11A, RASL11B, and RASL12, REM such as REM1, and REM2, GEM, RERG, RERGL, and RRAD.

Engineered immune cells can be accomplished by transducing a cell compositions with a polypeptide of a biocircuit, an effector module, a SRE and/or a payload of interest (i.e., immunotherapeutic agent), or a polynucleotide encoding said polypeptide, or a vector comprising said polynucleotide. The vector may be a viral vector such as a lentiviral vector, a gamma-retroviral vector, a recombinant AAV, an adenoviral vector and an oncolytic viral vector. In other aspects, non-viral vectors for example, nanoparticles and liposomes may also be used. In some embodiments, immune cells of the invention are genetically modified to express at least one immunotherapeutic agent of the invention which is tunable using a stimulus. In some examples, two, three or more immunotherapeutic agents constructed in the same biocircuit and effector module are introduced into a cell. In other examples, two, three, or more biocircuits, effector modules, each of which comprises an immunotherapeutic agent, may be introduced into a cell.

In some embodiments, immune cells of the invention may be T cells modified to express an antigen-specific T cell receptor (TCR), or an antigen specific chimeric antigen receptor (CAR) taught herein (known as CAR T cells). Accordingly, at least one polynucleotide encoding a CAR system (or a TCR) described herein, or a vector comprising the polynucleotide is introduced into a T cell. The T cell expressing the CAR or TCR binds to a specific antigen via the extracellular targeting moiety of the CAR or TCR, thereby a signal via the intracellular signaling domain (s) is transmitted into the T cell, and as a result, the T cell is activated. The activated CAR T cell changes its behavior including release of a cytotoxic cytokine (e.g., a tumor necrosis factor, and lymphotoxin, etc.), improvement of a cell proliferation rate, change in a cell surface molecule, or the like. Such changes cause destruction of a target cell expressing the antigen recognized by the CAR or TCR. In addition, release of a cytokine or change in a cell surface molecule stimulates other immune cells, for example, a B cell, a dendritic cell, a NK cell, and a macrophage.

The CAR introduced into a T cell may be a first-generation CAR including only the intracellular signaling domain from TCR CD3zeta, or a second-generation CAR including the intracellular signaling domain from TCR CD3zeta and a costimulatory signaling domain, or a third-generation CAR including the intracellular signaling domain from TCR CD3zeta and two or more costimulatory signaling domains, or a split CAR system, or an on/off switch CAR system. In one example, the expression of the CAR or TCR is controlled by a destabilizing domain (DD) such as a hDHFR mutant, in the effector module of the invention. The presence or absence of hDHFR binding ligand such as TMP is used to tune the CAR or TCR expression in transduced T cells or NK cells.

In some embodiments, CAR T cells of the invention may be further modified to express another one, two, three or more immunotherapeutic agents. The immunotherapeutic agents may be another CAR or TCR specific to a different target molecule; a cytokine such as IL2, IL12, IL15 and IL18, or a cytokine receptor such as IL15Rα; a chimeric switch receptor that converts an inhibitory signal to a stimulatory signal; a homing receptor that guides adoptively transferred cells to a target site such as the tumor tissue; an agent that optimizes the metabolism of the immune cell; or a safety switch gene (e.g., a suicide gene) that kills activated T cells when a severe event is observed after adoptive cell transfer or when the transferred immune cells are no-longer needed. These molecules may be included in the same effector module or in separate effector modules.

In one embodiment, the CAR T cell (including TCR T cell) of the invention may be an "armed" CAR T cell which is transformed with an effector module comprising a CAR and an effector module comprising a cytokine. The inducible or constitutively secrete active cytokines further armor CAR T cells to improve efficacy and persistence. In this context, such CAR T cell is also referred to as "armored CAR T cell". The "armor" molecule may be selected based on the tumor microenvironment and other elements of the innate and adaptive immune systems. In some embodiments, the molecule may be a stimulatory factor such as IL2, IL12, IL15, IL18, type I IFN, CD40L and 4-1BBL which have been shown to further enhance CAR T cell efficacy and persistence in the face of a hostile tumor microenvironment via different mechanisms (Yeku et al., *Biochem Soc Trans.,* 2016, 44(2): 412-418).

In some aspects, the armed CAR T cell of the invention is modified to express a CD19 CAR and IL12. Such T cells, after CAR mediated activation in the tumor, release inducible IL12 which augments T-cell activation and attracts and activates innate immune cells to eliminate CD19-negative cancer cells.

In one embodiment, T cells of the invention may be modified to express an effector module comprising a CAR and an effector module comprising a suicide gene.

In one embodiment, the CAR T cell (including TCR T cell) of the invention may be transformed with effector modules comprising a cytokine and a safety switch gene (e.g., suicide gene). The suicide gene may be an inducible caspase such as caspase 9 which induces apoptosis, when activated by an extracellular stimulus of a biocircuit system. Such induced apoptosis eliminates transferred cell as required to decrease the risk of direct toxicity and uncontrolled cell proliferation.

In some embodiments, immune cells of the invention may be NK cells modified to express an antigen-specific T cell receptor (TCR), or an antigen specific chimeric antigen receptor (CAR) taught herein.

Natural killer (NK) cells are members of the innate lymphoid cell family and characterized in humans by expression of the phenotypic marker CD56 (neural cell adhesion molecule) in the absence of CD3 (T-cell co-receptor). NK cells are potent effector cells of the innate immune system which mediate cytotoxic attack without the requirement of prior antigen priming, forming the first line of defense against diseases including cancer malignancies and viral infection.

Several pre-clinical and clinical trials have demonstrated that adoptive transfer of NK cells is a promising treatment approach against cancers such as acute myeloid leukemia (Ruggeri et al., *Science;* 2002, 295: 2097-2100; and Geller et al., *Immunotherapy,* 2011, 3: 1445-1459). Adoptive transfer of NK cells expressing CAR such as DAP12-Based Activating CAR revealed improved eradication of tumor cells (Topfer et al., *J Immunol.* 2015; 194:3201-3212). NK cell engineered to express a CS-1 specific CAR also displayed enhanced cytolysis and interferon-γ (IFN γ) production in multiple myeloma (Chu et al., *Leukemia,* 2014, 28(4): 917-927).

NK cell activation is characterized by an array of receptors with activating and inhibitory functions. The important activation receptors on NK cells include CD94/NKG2C and NKG2D (the C-type lectin-like receptors), and the natural cytotoxicity receptors (NCR) NKp30, NKp44 and NKp46, which recognize ligands on tumor cells or virally infected cells. NK cell inhibition is essentially mediated by interactions of the polymorphic inhibitory killer cell immunoglobulin-like receptors (KIRs) with their cognate human-leukocyte-antigen (HLA) ligands via the alpha-1 helix of the HLA molecule. The balance between signals that are generated from activating receptors and inhibitory receptors mainly determines the immediate cytotoxic activation.

NK cells may be isolated from peripheral blood mononuclear cells (PBMCs), or derived from human embryonic stem (ES) cells and induced pluripotent stem cells (iPSCs). The primary NK cells isolated from PBMCs may be further expanded for adoptive immunotherapy. Strategies and protocols useful for the expansion of NK cells may include interleukin 2 (IL2) stimulation and the use of autologous feeder cells, or the use of genetically modified allogeneic feeder cells. In some aspects, NK cells can be selectively expanded with a combination of stimulating ligands including IL15, IL21, IL2, 41BBL, IL12, IL18, MICA, 2B4, LFA-1, and BCM1/SLAMF2 (e.g., US patent publication NO: US20150190471).

Immune cells expressing effector modules comprising a CAR and/or other immunotherapeutic agents can be used as cancer immunotherapy. The immunotherapy comprises the cells expressing a CAR and/or other immunotherapeutic agents as an active ingredient, and may further comprise a suitable excipient. Examples of the excipient may include the pharmaceutically acceptable excipients, including various cell culture media, and isotonic sodium chloride.

In some embodiments, cells of the present invention may be dendritic cells that are genetically modified to express the compositions of the invention. Such cells may be used as cancer vaccines.

III. PHARMACEUTICAL COMPOSITIONS AND FORMULATIONS

The present invention further provides pharmaceutical compositions comprising one or more biocircuits, effector modules, SREs (e.g., DDs), stimuli and payloads of interest (i.e., immunotherapeutic agents), vectors, cells and other components of the invention, and optionally at least one pharmaceutically acceptable excipient or inert ingredient.

As used herein the term "pharmaceutical composition" refers to a preparation of biocircuits, SREs, stimuli and payloads of interest (i.e., immunotherapeutic agents), other components, vectors, cells and described herein, or pharmaceutically acceptable salts thereof, optionally with other chemical components such as physiologically suitable carriers and excipients. The pharmaceutical compositions of the invention comprise an effective amount of one or more active compositions of the invention. The preparation of a pharmaceutical composition that contains at least one composition of the present invention and/or an additional active ingredient will be known to those skilled in the art considering the present disclosure, as exemplified by Remington's Pharmaceutical Sciences, 18th Ed. Mack Printing Company, 1990, incorporated herein by reference.

The term "excipient" or "inert ingredient" refers to an inactive substance added to a pharmaceutical composition and formulation to further facilitate administration of an active ingredient. For the purposes of the present disclosure, the phrase "active ingredient" generally refers to any one or more biocircuits, effector modules, SREs, stimuli and payloads of interest (i.e., immunotherapeutic agents), other components, vectors, and cells to be delivered as described herein. The phrases "pharmaceutically acceptable" refers to molecular entities and compositions that do not produce an adverse, allergic or other untoward reaction when administered to an animal, such as, for example, a human, as appropriate.

In some embodiments, pharmaceutical compositions and formulations are administered to humans, human patients or subjects. Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Subjects to which administration of the pharmaceutical compositions is contemplated include, but are not limited to, non-human mammals, including agricultural animals such as cattle, horses, chickens and pigs, domestic animals such as cats, dogs, or research animals such as mice, rats, rabbits, dogs and non-human primates. It will be understood that, for human administration, preparations should meet sterility, pyrogenicity, general safety and purity standards as required by FDA Office of Biological Standards.

A pharmaceutical composition and formulation in accordance with the invention may be prepared, packaged, and/or sold in bulk, as a single unit dose, and/or as a plurality of single unit doses. As used herein, a "unit dose" is discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

The compositions of the present invention may be formulated in any manner suitable for delivery. The formulation may be, but is not limited to, nanoparticles, poly (lactic-co-glycolic acid) (PLGA) microspheres, lipidoids, lipoplex, liposome, polymers, carbohydrates (including simple sugars), cationic lipids and combinations thereof.

In one embodiment, the formulation is a nanoparticle which may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG and PEGylated lipids. In another aspect, the lipid may be a cationic lipid such as, but not limited to, DLin-DMA, DLin-D-DMA, DLin-MC3-DMA, DLin-KC2-DMA and DODMA.

For polynucleotides of the invention, the formulation may be selected from any of those taught, for example, in International Application PCT/US2012/069610, the contents of which are incorporated herein by reference in its entirety.

Relative amounts of the active ingredient, the pharmaceutically acceptable excipient or inert ingredient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1 and 100, e.g., between 0.5 and 50, between 1-30, between 5-80, at least 80 (w/w) active ingredient.

Efficacy of treatment or amelioration of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. In connection with the administration of compositions of the present invention, "effective against" for example a cancer, indicates that administration in a clinically appropriate manner results in a beneficial effect for at least a statistically significant fraction of patients, such as an improvement of symptoms, a cure, a reduction in disease load, reduction in tumor mass or cell numbers, extension of life, improvement in quality of life, or other effect generally recognized as positive by medical doctors familiar with treating the particular type of cancer.

A treatment or preventive effect is evident when there is a statistically significant improvement in one or more parameters of disease status, or by a failure to worsen or to develop symptoms where they would otherwise be anticipated. As an example, a favorable change of at least 10 in a measurable parameter of disease, and preferably at least 20, 30, 40, 50 or more can be indicative of effective treatment. Efficacy for a given composition or formulation of the present invention can also be judged using an experimental animal model for the given disease as known in the art. When using an experimental animal model, efficacy of treatment is evidenced when a statistically significant change is observed.

IV. DELIVERY MODALITIES AND/OR VECTORS

Vectors

The present invention also provides vectors that package polynucleotides of the invention encoding biocircuits, effector modules, SREs (DDs) and payload constructs, and combinations thereof. In some embodiments, polynucleotides encoding destabilizing domains, effector modules and biocircuit systems, are provided. Vectors comprising polynucleotides of the invention are provided. In some aspects, the vector may be a non-viral vector, or a viral vector. In some embodiments, the vector of the invention is a viral vector. The viral vector may include, but is not limited to a retroviral vector, an adenoviral vector, an adeno-associated viral vector, or a lentiviral vector. In some embodiments, the vector of the invention may be a non-viral vector, such as a nanoparticles and liposomes.

Vectors of the present invention may also be used to deliver the packaged polynucleotides to a cell, a local tissue site or a subject. These vectors may be of any kind, including DNA vectors, RNA vectors, plasmids, viral vectors and particles. Viral vector technology is well known and described in Sambrook et al. (2001, Molecular Cloning: A Laboratory Manual, Cold Spring Harbor Laboratory, New York). Viruses, which are useful as vectors include, but are not limited to lentiviral vectors, adenoviral vectors, adeno-associated viral (AAV) vectors, herpes simplex viral vectors, retroviral vectors, oncolytic viruses, and the like.

In general, vectors contain an origin of replication functional in at least one organism, a promoter sequence and convenient restriction endonuclease site, and one or more selectable markers e.g. a drug resistance gene.

As used herein a promoter is defined as a DNA sequence recognized by transcription machinery of the cell, required to initiate specific transcription of the polynucleotide sequence of the present invention. Vectors can comprise native or non-native promoters operably linked to the polynucleotides of the invention. The promoters selected may be strong, weak, constitutive, inducible, tissue specific, development stage-specific, and/or organism specific. One example of a suitable promoter is the immediate early cytomegalovirus (CMV) promoter sequence. This promoter sequence is a strong constitutive promoter sequence capable of driving high levels of expression of polynucleotide sequence that is operatively linked to it. Another example of a preferred promoter is Elongation Growth Factor-1. Alpha (EF-1. alpha). Other constitutive promoters may also be used, including, but not limited to simian virus 40 (SV40), mouse mammary tumor virus (MMTV), human immunodeficiency virus (HIV), long terminal repeat (LTR), promoter, an avian leukemia virus promoter, an Epstein-Barr virus immediate early promoter, a Rous sarcoma virus promoter as well as human gene promoters including, but not limited to the phosphoglycerate kinase (PGK) promoter, actin promoter, the myosin promoter, the hemoglobin promoter, the Ubiquitin C (Ubc) promoter, the human U6 small nuclear protein promoter and the creatine kinase promoter. In some instances, inducible promoters such as but not limited to metallothionine promoter, glucocorticoid promoter, a progesterone promoter, and a tetracycline promoter may be used. In some embodiments, the promoter may be selected from the following a CMV promoter, comprising a nucleotide sequence of SEQ ID NO. 335, an EF1a promoter, comprising a nucleotide sequence of SEQ ID NOs. 336-337, and a PGK promoter, comprising a nucleotide sequence of SEQ ID NO. 338.

In some embodiments, the optimal promoter may be selected based on its ability to achieve minimal expression of the SREs and payloads of the invention in the absence of the ligand and detectable expression in the presence of the ligand.

Additional promoter elements e.g. enhancers may be used to regulate the frequency of transcriptional initiation. Such regions may be located 10-100 base pairs upstream or downstream of the start site. In some instances, two or more promoter elements may be used to cooperatively or independently activate transcription.

In some embodiments, the recombinant expression vector may comprise regulatory sequences, such as transcription and translation initiation and termination codons, which are specific to the type of host cell into which the vector is to be introduced.

1. Lentiviral Vectors

In some embodiments, lentiviral vectors/particles may be used as vehicles and delivery modalities. Lentiviruses are subgroup of the Retroviridae family of viruses, named because reverse transcription of viral RNA genomes to DNA is required before integration into the host genome. As such, the most important features of lentiviral vehicles/particles are the integration of their genetic material into the genome of a target/host cell. Some examples of lentivirus include the Human Immunodeficiency Viruses: HIV-1 and HIV-2, the Simian Immunodeficiency Virus (SIV), feline immunodeficiency virus (FIV), bovine immunodeficiency virus (BIV), Jembrana Disease Virus (JDV), equine infectious anemia virus (EIAV), equine infectious anemia virus, visna-maedi and caprine arthritis encephalitis virus (CAEV).

Typically, lentiviral particles making up the gene delivery vehicle are replication defective on their own (also referred to as "self-inactivating"). Lentiviruses can infect both dividing and non-dividing cells by virtue of the entry mechanism through the intact host nuclear envelope (Naldini L et al., Curr. Opin. Biotechnol, 1998, 9: 457-463). Recombinant lentiviral vehicles/particles have been generated by multiply attenuating the HIV virulence genes, for example, the genes Env, Vif, Vpr, Vpu, Nef and Tat are deleted making the vector biologically safe. Correspondingly, lentiviral vehicles, for example, derived from HIV-1/HIV-2 can mediate the efficient delivery, integration and long-term expression of transgenes into non-dividing cells. As used herein, the term "recombinant" refers to a vector or other nucleic acid containing both lentiviral sequences and non-lentiviral retroviral sequences.

Lentiviral particles may be generated by co-expressing the virus packaging elements and the vector genome itself in a producer cell such as human HEK293T cells. These elements are usually provided in three (in second generation lentiviral systems) or four separate plasmids (in third generation lentiviral systems). The producer cells are co-transfected with plasmids that encode lentiviral components including the core (i.e. structural proteins) and enzymatic components of the virus, and the envelope protein(s) (referred to as the packaging systems), and a plasmid that encodes the genome including a foreign transgene, to be transferred to the target cell, the vehicle itself (also referred to as the transfer vector). In general, the plasmids or vectors are included in a producer cell line. The plasmids/vectors are introduced via transfection, transduction or infection into the producer cell line. Methods for transfection, transduction or infection are well known by those of skill in the art. As non-limiting example, the packaging and transfer constructs can be introduced into producer cell lines by calcium phosphate transfection, lipofection or electroporation, generally together with a dominant selectable marker, such as neo, DHFR, Gln synthetase or ADA, followed by selection in the presence of the appropriate drug and isolation of clones.

The producer cell produces recombinant viral particles that contain the foreign gene, for example, the effector module of the present invention. The recombinant viral particles are recovered from the culture media and titrated by standard methods used by those of skill in the art. The recombinant lentiviral vehicles can be used to infect target cells.

Cells that can be used to produce high-titer lentiviral particles may include, but are not limited to, HEK293T cells, 293G cells, STAR cells (Relander et al., *Mol. Ther.*, 2005, 11: 452-459), FreeStyle™ 293 Expression System (ThermoFisher, Waltham, Mass.), and other HEK293T-based producer cell lines (e.g., Stewart et al., *Hum Gene Ther.* 2011, 22(3):357-369; Lee et al., *Biotechnol Bioeng,* 2012, 10996): 1551-1560; Throm et al., *Blood.* 2009, 113(21): 5104-5110; the contents of each of which are incorporated herein by reference in their entirety).

In some aspects, the envelope proteins may be heterologous envelop proteins from other viruses, such as the G protein of vesicular stomatitis virus (VSV G) or baculoviral gp64 envelop proteins. The VSV-G glycoprotein may especially be chosen among species classified in the vesiculovirus genus: *carajas* virus (CJSV), Chandipura virus (CHPV), Cocal virus (COCV), *isfahan* virus (ISFV), *maraba* virus (MARAV), *piry* virus (PIRYV), Vesicular stomatitis *alagoas* virus (VSAV), Vesicular stomatitis *indiana* virus (VSIV) and Vesicular stomatitis New Jersey virus (VSNJV) and/or stains provisionally classified in the vesiculovirus genus as *grass* carp rhabdovirus, BeAn 157575 virus (BeAn 157575), Boteke virus (BTKV), *calchaqui* virus (CQIV), *Eel* virus American (EVA), Gray Lodge virus (GLOV), Jurona virus (JURY), *klamath* virus (KLAV), *kwatta* virus (KWAV), *La joya* virus (LJV), Malpais Spring virus (MSPV), Mount *elgon* bat virus (MEBV), Perinet virus (PERV), Pike fry rhabdovirus (PFRV), Porton virus (PORV), Radi virus (RADIV), Spring viremia of carp virus (SVCV), *Tupaia* virus (TUPV), Ulcerative disease rhabdovirus (UDRV) and Yug Bogdanovac virus (YBV). The gp64 or other baculoviral env protein can be derived from *Autographa californica* nucleopolyhedrovirus (AcMNPV), *Anagrapha falcifera* nuclear polyhedrosis virus, *Bombyx mori* nuclear polyhedrosis virus, *Choristoneura fumiferana* nucleopolyhedrovirus, *Orgyia pseudotsugata* single capsid nuclear polyhedrosis virus, *Epiphyas postvittana* nucleopolyhedrovirus, *Hyphantria cunea* nucleopolyhedrovirus, *Galleria mellonella* nuclear polyhedrosis virus, Dhori virus, Thogoto virus, *Antheraea pemyi* nucleopolyhedrovirus or Batken virus.

Additional elements provided in lentiviral particles may comprise retroviral LTR (long-terminal repeat) at either 5' or 3' terminus, a retroviral export element, optionally a lentiviral reverse response element (RRE), a promoter or active portion thereof, and a locus control region (LCR) or active portion thereof. Other elements include central polypurine tract (cPPT) sequence to improve transduction efficiency in non-dividing cells, Woodchuck Hepatitis Virus (WHP) Post-transcriptional Regulatory Element (WPRE) which enhances the expression of the transgene, and increases titer. The effector module is linked to the vector.

Methods for generating recombinant lentiviral particles are discussed in the art, for example, U.S. Pat. Nos. 8,846,385; 7,745,179; 7,629,153; 7,575,924; 7,179,903; and 6,808,905; the contents of each of which are incorporated herein by reference in their entirety.

Lentivirus vectors used may be selected from, but are not limited to pLVX, pLenti, pLenti6, pLJM1, FUGW, pWPXL, pWPI, pLenti CMV puro DEST, pLJM1-EGFP, pULTRA, pInducer20, pHIV-EGFP, pCW57.1, pTRPE, pELPS, pRRL, and pLionII.

Lentiviral vehicles known in the art may also be used (See, U.S. Pat. Nos. 9,260,725; 9,068,199; 9,023,646; 8,900,858; 8,748,169; 8,709,799; 8,420,104; 8,329,462; 8,076,106; 6,013,516; and 5,994,136; International Patent Publication NO.: WO2012079000; the contents of each of which are incorporated herein by reference in their entirety).

2. Retroviral Vectors (γ-Retroviral Vectors)

In some embodiments, retroviral vectors may be used to package and deliver the biocircuits, biocircuit components, effector modules, SREs or payload constructs of the present invention. Retroviral vectors (RVs) allow the permanent integration of a transgene in target cells. In addition to lentiviral vectors based on complex HIV-1/2, retroviral vectors based on simple gamma-retroviruses have been widely used to deliver therapeutic genes and demonstrated clinically as one of the most efficient and powerful gene delivery systems capable of transducing a broad range of cell types. Example species of Gamma retroviruses include the murine leukemia viruses (MLVs) and the feline leukemia viruses (FeLV).

In some embodiments, gamma-retroviral vectors derived from a mammalian gamma-retrovirus such as murine leukemia viruses (MLVs), are recombinant. The MLV families of gamma retroviruses include the ecotropic, amphotropic, xenotropic and polytropic subfamilies. Ecotropic viruses are able to infect only murine cells using mCAT-1 receptor. Examples of ecotropic viruses are Moloney MLV and AKV. Amphotropic viruses infect murine, human and other species through the Pit-2 receptor. One example of an amphotropic virus is the 4070A virus. Xenotropic and polytropic viruses utilize the same (Xpr1) receptor, but differ in their species tropism. Xenotropic viruses such as NZB-9-1 infect human and other species but not murine species, whereas polytropic viruses such as focus-forming viruses (MCF) infect murine, human and other species.

Gamma-retroviral vectors may be produced in packaging cells by co-transfecting the cells with several plasmids including one encoding the retroviral structural and enzymatic (gag-pol) polyprotein, one encoding the envelope (env) protein, and one encoding the vector mRNA comprising polynucleotide encoding the compositions of the present invention that is to be packaged in newly formed viral particles.

In some aspects, the recombinant gamma-retroviral vectors are pseudotyped with envelope proteins from other viruses. Envelope glycoproteins are incorporated in the outer lipid layer of the viral particles which can increase/alter the cell tropism. Exemplary envelop proteins include the gibbon ape leukemia virus envelope protein (GALV) or vesicular stomatitis virus G protein (VSV-G), or Simian endogenous retrovirus envelop protein, or Measles Virus H and F proteins, or Human immunodeficiency virus gp120 envelope protein, or cocal vesiculovirus envelop protein (See, e.g., U.S. application publication NO.: 2012/164118; the contents of which are incorporated herein by reference in its entirety). In other aspects, envelope glycoproteins may be genetically modified to incorporate targeting/binding ligands into gamma-retroviral vectors, binding ligands including, but not limited to, peptide ligands, single chain antibodies and growth factors (Waehler et al., Nat. Rev. Genet. 2007, 8(8):573-587; the contents of which are incorporated herein by reference in its entirety). These engineered glycoproteins can retarget vectors to cells expressing their corresponding target moieties. In other aspects, a "molecular bridge" may be introduced to direct vectors to specific cells. The molecular bridge has dual specificities: one end can recognize viral glycoproteins, and the other end can bind to the molecular determinant on the target cell. Such molecular bridges, for example ligand-receptor, avidin-biotin, and chemical conjugations, monoclonal antibodies and engineered fusogenic proteins, can direct the attachment of viral vectors to target cells for transduction (Yang et al., Biotechnol. Bioeng., 2008, 101(2): 357-368; and Maetzig et al., Viruses, 2011, 3, 677-713; the contents of each of which are incorporated herein by reference in their entirety).

In some embodiments, the recombinant gamma-retroviral vectors are self-inactivating (SIN) gammaretroviral vectors. The vectors are replication incompetent. SIN vectors may harbor a deletion within the 3' U3 region initially comprising enhancer/promoter activity. Furthermore, the 5' U3 region may be replaced with strong promoters (needed in the packaging cell line) derived from Cytomegalovirus or RSV, or an internal promoter of choice, and/or an enhancer element. The choice of the internal promoters may be made according to specific requirements of gene expression needed for a particular purpose of the invention.

In some embodiments, polynucleotides encoding the biocircuit, biocircuit components, effector module, SRE are inserted within the recombinant viral genome. The other components of the viral mRNA of a recombinant gamma-retroviral vector may be modified by insertion or removal of naturally occurring sequences (e.g., insertion of an IRES, insertion of a heterologous polynucleotide encoding a polypeptide or inhibitory nucleic acid of interest, shuffling of a more effective promoter from a different retrovirus or virus in place of the wild-type promoter and the like). In some examples, the recombinant gamma-retroviral vectors may comprise modified packaging signal, and/or primer binding site (PBS), and/or 5'-enhancer/promoter elements in the U3-region of the 5'-long terminal repeat (LTR), and/or 3'-SIN elements modified in the U3-region of the 3'-LTR. These modifications may increase the titers and the ability of infection.

Gamma retroviral vectors suitable for delivering biocircuit components, effector modules, SREs or payload constructs of the present invention may be selected from those disclosed in U.S. Pat. Nos. 8,828,718; 7,585,676; 7,351,585; U.S. application publication NO.: 2007/048285; PCT application publication NOs.: WO2010/113037; WO2014/121005; WO2015/056014; and EP Pat. NOs.: EP1757702; EP1757703 (the contents of each of which are incorporated herein by reference in their entirety).

3. Adeno-Associated Viral Vectors (AAV)

In some embodiments, polynucleotides of present invention may be packaged into recombinant adeno-associated viral (rAAV) vectors. Such vectors or viral particles may be designed to utilize any of the known serotype capsids or combinations of serotype capsids. The serotype capsids may include capsids from any identified AAV serotypes and variants thereof, for example, AAV1, AAV2, AAV2G9, AAV3, AAV4, AAV4-4, AAV5, AAV6, AAV7, AAV8, AAV9, AAV10, AAV11, AAV12 and AAVrh10.

In one embodiment, the AAV serotype may be or have a sequence as described in United States Publication No. US20030138772, herein incorporated by reference in its entirety, such as, but not limited to, AAV1 (SEQ ID NO: 6 and 64 of US20030138772), AAV2 (SEQ ID NO: 7 and 70 of US20030138772), AAV3 (SEQ ID NO: 8 and 71 of US20030138772), AAV4 (SEQ ID NO: 63 of US20030138772), AAV5 (SEQ ID NO: 114 of US20030138772), AAV6 (SEQ ID NO: 65 of US20030138772), AAV7 (SEQ ID NO: 1-3 of US20030138772), AAV8 (SEQ ID NO: 4 and 95 of US20030138772), AAV9 (SEQ ID NO: 5 and 100 of US20030138772), AAV10 (SEQ ID NO: 117 of US20030138772), AAV11 (SEQ ID NO: 118 of US20030138772), AAV12 (SEQ ID NO: 119 of US20030138772), AAVrh10 (amino acids 1 to 738 of SEQ ID NO: 81 of US20030138772) or variants thereof. Non-limiting examples of variants include SEQ ID NOs: 9, 27-45, 47-62, 66-69, 73-81, 84-94, 96, 97, 99, 101-113 of US20030138772, the contents of which are herein incorporated by reference in their entirety.

In one embodiment, the AAV serotype may have a sequence as described in Pulicherla et al. (Molecular Therapy, 2011, 19(6):1070-1078), U.S. Pat. Nos. 6,156,303; 7,198,951; U.S. Patent Publication NOs.: US2015/0159173 and US2014/0359799; and International Patent Publication NOs.: WO1998/011244, WO2005/033321 and WO2014/14422; the contents of each of which are incorporated herein by reference in their entirety.

AAV vectors include not only single stranded vectors but self-complementary AAV vectors (scAAVs). scAAV vectors contain DNA which anneals together to form double stranded vector genome. By skipping second strand synthesis, scAAVs allow for rapid expression in the cell.

The rAAV vectors may be manufactured by standard methods in the art such as by triple transfection, in sf9 insect cells or in suspension cell cultures of human cells such as HEK293 cells.

The biocircuits, biocircuit components, effector modules, SREs or payload constructs may be encoded in one or more viral genomes to be packaged in the AAV capsids taught herein.

Such vectors or viral genomes may also include, in addition to at least one or two ITRs (inverted terminal repeats), certain regulatory elements necessary for expression from the vector or viral genome. Such regulatory elements are well known in the art and include for example promoters, introns, spacers, stuffer sequences, and the like.

In some embodiments, more than one effector module or SRE (e.g. DD) may be encoded in a viral genome.

4. Oncolytic Viral Vector

In some embodiments, polynucleotides of present invention may be packaged into oncolytic viruses, such as vaccine viruses. Oncolytic vaccine viruses may include viral particles of a thymidine kinase (TK)-deficient, granulocyte macrophage (GM)-colony stimulating factor (CSF)-expressing, replication-competent vaccinia virus vector sufficient to induce oncolysis of cells in the tumor (e.g., U.S. Pat. No. 9,226,977).

In some embodiments, the viral vector of the invention may comprise two or more immunotherapeutic agents taught herein, wherein the two or more immunotherapeutic agents may be included in one effector module under the regulation of the same DD. In this case, the two or more immunotherapeutic agents are tuned by the same stimulus simultaneously. In other embodiments, the viral vector of the invention may comprise two or more effector modules, wherein each effector module comprises a different immunotherapeutic agent. In this case, the two or more effector modules and immunotherapeutic agents are tuned by different stimuli, providing separately independent regulation of the two or more components.

5. Messenger RNA (mRNA)

In some embodiments, the effector modules of the invention may be designed as a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo. Such mRNA molecules may have the structural components or features of any of those taught in International Application number PCT/US2013/030062, the contents of which are incorporated herein by reference in its entirety.

Polynucleotides of the invention may also be designed as taught in, for example, Ribostem Limited in United Kingdom patent application serial number 0316089.2 filed on Jul. 9, 2003 now abandoned, PCT application number PCT/GB2004/002981 filed on Jul. 9, 2004 published as WO2005005622, United States patent application national phase entry Ser. No. 10/563,897 filed on Jun. 8, 2006 published as US20060247195 now abandoned, and European patent application national phase entry serial number EP2004743322 filed on Jul. 9, 2004 published as EP1646714 now withdrawn; Novozymes, Inc. in PCT application number PCT/US2007/88060 filed on Dec. 19, 2007 published as WO2008140615, United States patent application national phase entry Ser. No. 12/520,072 filed on Jul. 2, 2009 published as US20100028943 and European patent application national phase entry serial number EP2007874376 filed on Jul. 7, 2009 published as EP2104739; University of Rochester in PCT application number PCT/US2006/46120 filed on Dec. 4, 2006 published as WO2007064952 and U.S. patent application Ser. No. 11/606,995 filed on Dec. 1, 2006 published as US20070141030; BioNTech AG in European patent application serial number EP2007024312 filed Dec. 14, 2007 now abandoned, PCT application number PCT/EP2008/01059 filed on Dec. 12, 2008 published as WO2009077134, European patent application national phase entry serial number EP2008861423 filed on Jun. 2, 2010 published as EP2240572, United States patent application national phase entry Ser. No. 12/735,060 filed Nov. 24, 2010 published as US20110065103, German patent application serial number DE 10 2005 046 490 filed Sep. 28, 2005, PCT application PCT/EP2006/0448 filed Sep. 28, 2006 published as WO2007036366, national phase European patent EP1934345 published Mar. 21, 2012 and national phase U.S. patent application Ser. No. 11/992,638 filed Aug. 14, 2009 published as 20100129877; Immune Disease Institute Inc. in U.S. patent application Ser. No. 13/088,009 filed Apr. 15, 2011 published as US20120046346 and PCT application PCT/US2011/32679 filed Apr. 15, 2011 published as WO20110130624; Shire Human Genetic Therapeutics in U.S. patent application Ser. No. 12/957,340 filed on Nov. 20, 2010 published as US20110244026; Sequitur Inc. in PCT application PCT/US1998/019492 filed on Sep. 18, 1998 published as WO1999014346; The Scripps Research Institute in PCT application number PCT/US2010/00567 filed on Feb. 24, 2010 published as WO2010098861, and United States patent application national phase entry Ser. No. 13/203,229 filed Nov. 3, 2011 published as US20120053333; Ludwig-Maximillians University in PCT application number PCT/EP2010/004681 filed on Jul. 30, 2010 published as WO2011012316; Cellscript Inc. in U.S. Pat. No. 8,039,214 filed Jun. 30, 2008 and granted Oct. 18, 2011, U.S. patent application Ser. No. 12/962,498 filed on Dec. 7, 2010 published as US20110143436, Ser. No. 12/962,468 filed on Dec. 7, 2010 published as US20110143397, Ser. No. 13/237,451 filed on Sep. 20, 2011 published as US20120009649, and PCT applications PCT/US2010/59305 filed Dec. 7, 2010 published as WO2011071931 and PCT/US2010/59317 filed on Dec. 7, 2010 published as WO2011071936; The Trustees of the University of Pennsylvania in PCT application number PCT/US2006/32372 filed on Aug. 21, 2006 published as WO2007024708, and U.S. patent application national phase entry Ser. No. 11/990,646 filed on Mar. 27, 2009 published as US20090286852; Curevac GMBH in German patent application serial numbers DE10 2001 027 283.9 filed Jun. 5, 2001, DE10 2001 062 480.8 filed Dec. 19, 2001, and DE 20 2006 051 516 filed Oct. 31, 2006 all abandoned, European patent numbers EP1392341 granted Mar. 30, 2005 and EP1458410 granted Jan. 2, 2008, PCT application numbers PCT/EP2002/06180 filed Jun. 5, 2002 published as WO2002098443, PCT/EP2002/14577 filed on Dec. 19, 2002 published as WO2003051401, PCT/EP2007/09469 filed on Dec. 31, 2007 published as WO2008052770, PCT/EP2008/03033 filed on Apr. 16, 2008 published as WO2009127230, PCT/EP2006/004784 filed on May 19, 2005 published as WO2006122828, PCT/EP2008/00081 filed on Jan. 9, 2007 published as WO2008083949, and U.S. patent application Ser. No. 10/729,830 filed on Dec. 5, 2003 published as US20050032730, Ser. No. 10/870,110 filed on Jun. 18, 2004 published as US20050059624, Ser. No. 11/914,945 filed on Jul. 7, 2008 published as US20080267873, Ser. No. 12/446,912 filed on Oct. 27, 2009 published as US2010047261 now abandoned, Ser. No. 12/522,214 filed on Jan. 4, 2010 published as US20100189729, Ser. No. 12/787,566 filed on May 26, 2010 published as US20110077287, Ser. No. 12/787,755 filed on May 26, 2010 published as US20100239608, Ser. No. 13/185,119 filed on Jul. 18, 2011 published as US20110269950, and Ser. No. 13/106,548 filed on May 12, 2011 published as US20110311472 all of which are herein incorporated by reference in their entirety.

In some embodiments, the effector modules may be designed as self-amplifying RNA. "Self-amplifying RNA" as used herein refers to RNA molecules that can replicate in the host resulting in the increase in the amount of the RNA and the protein encoded by the RNA. Such self-amplifying RNA may have structural features or components of any of those taught in International Patent Application Publication No. WO2011005799 (the contents of which are incorporated herein by reference in their entirety.)

V. DOSING, DELIVERY AND ADMINISTRATIONS

The compositions of the invention may be delivered to a cell or a subject through one or more routes and modalities. The viral vectors containing one or more effector modules, SREs, immunotherapeutic agents and other components described herein may be used to deliver them to a cell and/or a subject. Other modalities may also be used such as mRNAs, plasmids, and as recombinant proteins.

1. Delivery to Cells

In another aspect of the invention, polynucleotides encoding biocircuits, effector modules, SREs (e.g., DDs), payloads of interest (immunotherapeutic agents) and compositions of the invention and vectors comprising said polynucleotides may be introduced into cells such as immune effector cells.

In one aspect of the invention, polynucleotides encoding biocircuits, effector modules, SREs (e.g., DDs), payloads of interest (immunotherapeutic agents) and compositions of the invention, may be packaged into viral vectors or integrated into viral genomes allowing transient or stable expression of the polynucleotides. Preferable viral vectors are retroviral vectors including lentiviral vectors. In order to construct a retroviral vector, a polynucleotide molecule encoding a biocircuit, an effector module, a DD or a payload of interest (i.e. an immunotherapeutic agent) is inserted into the viral genome in the place of certain viral sequences to produce a virus that is replication-defective. The recombinant viral vector is then introduced into a packaging cell line containing the gag, pol, and env genes, but without the LTR and packaging components. The recombinant retroviral particles are secreted into the culture media, then collected, optionally concentrated, and used for gene transfer. Lentiviral vectors are especially preferred as they are capable of infecting both dividing and non-dividing cells.

Vectors may also be transferred to cells by non-viral methods by physical methods such as needles, electroporation, sonoporation, hyrdoporation; chemical carriers such as inorganic particles (e.g. calcium phosphate, silica, gold) and/or chemical methods. In some embodiments, synthetic or natural biodegradable agents may be used for delivery such as cationic lipids, lipid nano emulsions, nanoparticles, peptide based vectors, or polymer based vectors.

In some embodiments, the polypeptides of the invention may be delivered to the cell directly. In one embodiment, the polypeptides of the invention may be delivered using synthetic peptides comprising an endosomal leakage domain (ELD) fused to a cell penetration domain (CLD). The polypeptides of the invention are co introduced into the cell with the ELD-CLD-synthetic peptide. ELDs facilitate the escape of proteins that are trapped in the endosome, into the cytosol. Such domains are derived proteins of microbial and viral origin and have been described in the art. CPDs allow the transport of proteins across the plasma membrane and have also been described in the art. The ELD-CLD fusion proteins synergistically increase the transduction efficiency when compared to the co-transduction with either domain alone. In some embodiments, a histidine rich domain may optionally be added to the shuttle construct as an additional method of allowing the escape of the cargo from the endosome into the cytosol. The shuttle may also include a cysteine residue at the N or C terminus to generate multimers of the fusion peptide. Multimers of the ELD-CLD fusion peptides generated by the addition of cysteine residue to the terminus of the peptide show even greater transduction efficiency when compared to the single fusion peptide constructs. The polypeptides of the invention may also be appended to appropriate localization signals to direct the cargo to the appropriate sub-cellular location e.g. nucleus. In some embodiments any of the ELDs, CLDs or the fusion ELD-CLD synthetic peptides taught in the International Patent Publication, WO2016161516 and WO2017175072 may be useful in the present invention (the contents of each of which are herein incorporated by reference in their entirety).

2. Dosing

The present invention provides methods comprising administering any one or more compositions for immunotherapy to a subject in need thereof. These may be administered to a subject using any amount and any route of administration effective for preventing or treating a clinical condition such as cancer, infection diseases and other immunodeficient diseases.

Compositions in accordance with the invention are typically formulated in dosage unit form for ease of administration and uniformity of dosage. It will be understood, however, that the total daily usage of the compositions of the present invention may be decided by the attending physician within the scope of sound medical judgment. The specific therapeutically effective, or prophylactically effective dose level for any particular patient will depend upon a variety of factors including the disorder being treated and the severity of the disorder; the activity of the specific compound employed; the specific composition employed; the age, body weight, general health, sex and diet of the patient; the time of administration, route of administration, previous or concurrent therapeutic interventions and rate of excretion of the specific compound employed; the duration of the treatment; drugs used in combination or coincidental with the specific compound employed; and like factors well known in the medical arts.

Compositions of the invention may be used in varying doses to avoid T cell anergy, prevent cytokine release syndrome and minimize toxicity associated with immunotherapy. For example, low doses of the compositions of the present invention may be used to initially treat patients with high tumor burden, while patients with low tumor burden may be treated with high and repeated doses of the compositions of the invention to ensure recognition of a minimal tumor antigen load. In another instance, the compositions of the present invention may be delivered in a pulsatile fashion to reduce tonic T cell signaling and enhance persistence in vivo. In some aspects, toxicity may be minimized by initially using low doses of the compositions of the invention, prior to administering high doses. Dosing may be modified if serum markers such as ferritin, serum C-reactive protein, IL6, IFN γ, and TNF-α are elevated.

In one embodiment, polypeptides and/or polynucleotides expressing the compositions described herein e.g. effector modules, are administered to a subject in need thereof to treat cancer. In one embodiment, a population of cells comprising the biocircuits, effector modules and/or the SREs described herein is administered to a subject in need thereof to treat cancer.

In one embodiment, the cells expressing the compositions described herein is administered at a dose and/or dosing schedule described herein.

In one embodiment, compositions are introduced into immune cells (e.g., T cells, NK cells). The compositions may be introduced into the immune cells by methods including but not limited to viral transduction, transfection and/or in vitro transcription. In some embodiments, the immune cells are transduced with retroviruses. In one aspect, the retrovirus may be a lentivirus. In some aspects, the titer of the lentiviruses may be used to tune the expression of the payload. In some embodiments, the titer of the lentivirus may have a multiplicity of infection (MOI) ranging from 0.001-0.01, 0.01-0.1, 0.1-1, or 1-10. In some embodiments, the MOI may be 1, 2, 3, 4, 5, 6, 7, 8, 9, or 10.

In some embodiments, the subject (e.g., human) receives an initial administration of immune cells comprising the compositions described herein e.g. SREs, and one or more subsequent administrations of cells. In some embodiments, a therapeutically effective amount of the compositions and/or cells described herein may be administered to the subject. In some embodiments, the therapeutically effective amount may indicate the precise amount required to tumor inhibition, tumor prevalence and/or tumor burden. The therapeutically effective amount may be determined with consideration of the subject's age, weight, tumor size, sex, extent of infection or metastasis. In some embodiments, the cells expressing the compositions described herein may be administered at a dosage of $10^4$ to $10^9$ cells/kg body weight of the subject. The cells can be administered by using infusion techniques that are commonly known in immunotherapy (see, e.g., Rosenberg et al., New Eng. J. of Med. 319: 1676, 1988; the contents of which are incorporated herein by reference in their entirety).

In some aspects, subjects may undergo leukapheresis, wherein leukocytes are collected, enriched, or depleted ex vivo to select and/or isolate the cells of interest, e.g., T cells. These T cell isolates may be expanded by methods known in the art and treated such that the compositions of the invention may be introduced into the cell. Subjects in need thereof may subsequently undergo standard treatment with high dose chemotherapy followed by peripheral blood stem cell transplantation. In certain aspects, following or concurrent with the transplant, subjects receive an infusion of the immune cells of the present invention. In an additional aspect, expanded cells are administered before or following surgery.

The dosage of the above treatments to be administered to a patient will vary with the precise nature of the condition being treated and the recipient of the treatment. The scaling of dosages for human administration can be performed according to art-accepted practices.

In one embodiment, the compositions are introduced into immune cells (e.g., T cells, NK cells), e.g., using in vitro transcription, and the subject (e.g., human) receives an initial administration of immune cells (e.g., T cells, NK cells) of the invention, and one or more subsequent administrations of the immune cells (e.g., T cells, NK cells) of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the immune cells (e.g., T cells, NK cells) of the invention are administered to the subject (e.g., human) per week, e.g., 2, 3, or 4 administrations of the immune cells (e.g., T cells, NK cells) of the invention are administered per week. In one embodiment, the subject (e.g., human subject) receives more than one administration of the immune cells (e.g., T cells, NK cells) per week (e.g., 2, 3 or 4 administrations per week) (also referred to herein as a cycle), followed by a week of no immune cells (e.g., T cells, NK cells) administrations, and then one or more additional administration of the immune cells (e.g., T cells, NK cells) (e.g., more than one administration of the immune cells (e.g., T cells, NK cells) per week) is administered to the subject. In another embodiment, the subject (e.g., human subject) receives more than one cycle of immune cells (e.g., T cells, NK cells), and the time between each cycle is less than 10, 9, 8, 7, 6, 5, 4, or 3 days. In one embodiment, the immune cells (e.g., T cells, NK cells) are administered every other day for 3 administrations per week. In one embodiment, the immune cells (e.g., T cells, NK cells) of the invention are administered for at least two, three, four, five, six, seven, eight or more weeks. In some embodiments, a dose of immune cells expressing compositions of the invention described herein comprises about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, $3\times10^8$, or $5\times10^8$ cells/kg. In some embodiments, a dose of immune cells comprises at least about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, $3\times10^8$, or $5\times10^8$ cells/kg. In some embodiments, a dose of immune cells comprises up to about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, $3\times10^8$, or $5\times10^8$ cells/kg. In some embodiments, a dose of immune cells comprises about $1.1\times10^6$, $1.8\times10^7$ cells/kg. In some embodiments, a dose of immune cells comprises about $1\times10^7$, $2\times10^7$, $5\times10^7$, $1\times10^8$, $2\times10^8$, $3\times10^8$, $5\times10^8$, $1\times10^9$, $2\times10^9$, or $5\times10^9$ cells. In some embodiments, a dose of the immune cells comprises at least about $1\times10^7$, $2\times10^7$, $5\times10^7$, $1\times10^8$, $2\times10^8$, $3\times10^8$, $5\times10^8$, $1\times10^9$, $2\times10^9$, or $5\times10^9$ cells. In some embodiments, a dose of immune cells comprises up to about $1\times10^7$ $2\times10^7$, $5\times10^7$, $1\times10^8$, $2\times10^8$, $3\times10^8$, $5\times10^8$, $1\times10^9$, $2\times10^9$, or $5\times10^9$ cells. In some embodiments, a dose of the immune cells comprises up to about $1\times10^7$, $1.5\times10^7$, $2\times10^7$, $2.5\times10^7$, $3\times10^7$, $3.5\times10^7$, $4\times10^7$, $5\times10^7$, $1\times10^8$, $1.5\times10^8$, $2\times10^8$, $2.5\times10^8$, $3\times10^8$, $3.5\times10^8$, $4\times10^8$, $5\times10^8$, $1\times10^9$, $2\times10^9$, or $5\times10^9$ cells. In some embodiments, a dose of immune cells comprises up to about $1\text{-}3\times10^7$ to $1\text{-}3\times10^8$ cells.

In one embodiment, the cells expressing the compositions described herein, are administered as a first line treatment for the disease, e.g., the cancer, e.g., the cancer described herein. In another embodiment, the cells expressing the compositions described herein, are administered as a second, third, fourth line treatment for the disease, e.g., the cancer, e.g., the cancer described herein. In some embodiments, the subject may undergo preconditioning prior to the administration of the cells.

Also provided herein are methods of administering ligands in accordance with the invention to a subject in need thereof. The ligand may be administered to a subject or to cells, using any amount and any route of administration effective for tuning the biocircuits of the invention. The exact amount required will vary from subject to subject, depending on the species, age, and general condition of the subject, the severity of the disease, the particular composition, its mode of administration, its mode of activity, and the like. The subject may be a human, a mammal, or an animal. Compositions in accordance with the invention are typically formulated in unit dosage form for ease of administration and uniformity of dosage. It will be understood, however, that the total daily usage of the compositions of the present invention may be decided by the attending physician within the scope of sound medical judgment. In certain embodiments, the ligands in accordance with the present invention may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, from about 10 mg/kg to about 100 mg/kg, from about 50 mg/kg to about 500 mg/kg, from about 100 mg/kg to about 1000 mg/kg, of subject body weight per day, one or more times a day, to obtain the desired effect. In some embodiments, the dosage levels may be 1 mg/kg, 5 mg/kg, 10 mg/kg, 20 mg/kg, 30 mg/kg, 40 mg/kg, 50 mg/kg, 60 mg/kg, 70 mg/kg, 80 mg/kg, 90 mg/kg, 100 mg/kg, 100 mg/kg, 110 mg/kg, 120 mg/kg, 130 mg/kg, 140 mg/kg, 150 mg/kg, 160 mg/kg, 170 mg/kg, 180 mg/kg, 190 mg/kg or mg/kg of subject body weight per day, or more times a day, to obtain the desired effect.

The present disclosure provides methods for delivering to a cell or tissue any of the ligands described herein, comprising contacting the cell or tissue with said ligand and can be accomplished in vitro, ex vivo, or in vivo. In certain embodiments, the ligands in accordance with the present invention may be administered to cells at dosage levels sufficient to deliver from about 1 nM to about 10 nM, from about 5 nM to about 50 nM, from about 10 nM to about 100 nM, from about 50 nM to about 500 nM, from about 100 nM to about 1000 nM, from about 1 µM to about 10 µM, from about 5 µM to about 50 µM, from about 10 µM to about 100 µM from about 25 µM to about 250 µM, from about 50 µM to about 500 µM. In some embodiments, the ligand may be administered to cells at doses selected from but not limited to 0.0064 µM, 0.0032 µM, 0.016 µM, 0.08 µM, 0.4 µM, 1 µM, 2 µM, 5 µM, 10 µM, 25 µM, 50 µM, 75 µM, 100 µM, 150 µM, 200 µM, 250 µM.

The desired dosage of the ligands of the present invention may be delivered only once, three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. As used herein, a "split dose" is the division of "single unit dose" or total daily dose into two or more doses, e.g., two or more administrations of the "single unit dose". As used herein, a "single unit dose" is a dose of any therapeutic administered in one dose/at one time/single route/single point of contact, i.e., single administration event. The desired dosage of the ligand of the present invention may be administered as a "pulse dose" or as a "continuous flow". As used herein, a "pulse dose" is a series of single unit doses of any therapeutic administered with a set frequency over a period of time. As used herein, a "continuous flow" is a dose of therapeutic administered continuously for a period of time in a single route/single point of contact, i.e., continuous administration event. A total daily dose, an amount given or prescribed in 24-hour period, may be administered by any of these methods, or as a combination of these methods, or by any other methods suitable for a pharmaceutical administration.

3. Administration

In some embodiments, the compositions for immunotherapy may be administered to cells ex vivo and subsequently administered to the subject. Immune cells can be isolated and expanded ex vivo using a variety of methods known in the art. For example, methods of isolating cytotoxic T cells are described in U.S. Pat. Nos. 6,805,861 and 6,531,451; the contents of each of which are incorporated herein by reference in their entirety. Isolation of NK cells is described in U.S. Pat. No. 7,435,596; the contents of which are incorporated by reference herein in its entirety.

In some embodiments, depending upon the nature of the cells, the cells may be introduced into a host organism e.g. a mammal, in a wide variety of ways including by injection, transfusion, infusion, local instillation or implantation. In some aspects, the cells of the invention may be introduced at the site of the tumor. The number of cells that are employed will depend upon a number of circumstances, the purpose for the introduction, the lifetime of the cells, the protocol to be used, for example, the number of administrations, the ability of the cells to multiply, or the like. The cells may be in a physiologically-acceptable medium.

In some embodiments, the cells of the invention may be administrated in multiple doses to subjects having a disease or condition. The administrations generally effect an improvement in one or more symptoms of cancer or a clinical condition and/or treat or prevent cancer or clinical condition or symptom thereof.

In some embodiments, the compositions for immunotherapy may be administered in vivo. In some embodiments, polypeptides of the present invention comprising biocircuits, effector molecules, SREs, payloads of interest (immunotherapeutic agents) and compositions of the invention may be delivered in vivo to the subject. In vivo delivery of immunotherapeutic agents is well described in the art. For example, methods of delivery of cytokines are described in the E.P. Pat. No.: EP0930892 A1, the contents of which are incorporated herein by reference.

Routes of Delivery

The pharmaceutical compositions, biocircuits, biocircuit components, effector modules including their SREs (e.g., DDs), payloads (i.e. immunotherapeutic agents), vectors and cells of the present invention may be administered by any route to achieve a therapeutically effective outcome.

These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracranial (into the heart), intraosseous infusion (into the bone marrow), intrathecal (into the spinal canal), intraperitoneal, (infusion or injection into the peritoneum), intrasinal infusion, intravitreal, (through the eye), intravenous injection (into a pathologic cavity) intracavitary (into the base of the penis), intravaginal administration, intrauterine, extraamniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal.

Kits

The also provides a kit comprising any of the polynucleotides or expression vectors described herein.

The present invention includes a variety of kits for conveniently and/or effectively carrying out methods of the present invention. Typically, kits will comprise sufficient amounts and/or numbers of components to allow a user to perform one or multiple treatments of a subject(s) and/or to perform one or multiple experiments.

In one embodiment, the present invention provides kits for inhibiting genes in vitro or in vivo, comprising a biocircuit of the present invention or a combination of biocircuits of the present invention, optionally in combination with any other suitable active agents.

The kit may further comprise packaging and instructions and/or a delivery agent to form a formulation composition. The delivery agent may comprise, for example, saline, a buffered solution.

In additional embodiments, assay screening kits are provided. The kit includes a container for the screening assay. An instruction for the use of the assay and the information about the screening method are to be included in the kit.

In some embodiments, the DDs, effector modules and biocircuit system and compositions of the invention may be used as research tools to investigate protein activity in a biological system such a cell and a subject. In other embodiments, the DDs, effector modules and biocircuit system and compositions of the invention may be used for treating a disease such as a cancer and a genetic disorder.

VI. APPLICATIONS

In one aspect of the present invention, methods for reducing a tumor volume or burden are provided. The methods comprise administering a pharmaceutically effective amount of a pharmaceutical composition comprising at least one biocircuit system, effector module, DD, and/or payload of interest (i.e., an immunotherapeutic agent), at least one vector, or cells to a subject having a tumor. The biocircuit system and effector module having any immunotherapeutic agent as described herein may be in forms of a polypeptide, or a polynucleotide such as mRNA, or a viral vector comprising the polynucleotide, or a cell modified to express the biocircuit, effector module, DD, and payload of interest (i.e., immunotherapeutic agent).

In another aspect of the present invention, methods for inducing an anti-tumor immune response in a subject are provided. The methods comprise administering a pharmaceutically effective amount of a pharmaceutical composition comprising at least one biocircuit system, effector module, DD, and/or payload of interest (i.e., an immunotherapeutic agent), at least one vector, or cells to a subject having a tumor. The biocircuit and effector module having any immunotherapeutic agent as described herein may be in forms of a polypeptide, or a polynucleotide such as mRNA, or a viral vector comprising the polynucleotide, or a cell modified to express the biocircuit, effector module, DD, and payload of interest (i.e., immunotherapeutic agent).

The methods, per the present invention, may be adoptive cell transfer (ACT) using genetically engineered cells such as immune effector cells of the invention, cancer vaccines comprising biocircuit systems, effector modules, DDs, payloads of interest (i.e., immunotherapeutic agents) of the invention, or compositions that manipulate the tumor immunosuppressive microenvironment, or the combination thereof. These treatments may be further employed with other cancer treatment such as chemotherapy and radiotherapy.

1. Adoptive Cell Transfer (Adoptive Immunotherapy)

Recent progress in the field of cancer immunology has allowed the development of several approaches to help the immune system keep the cancer at bay. Such immunotherapy approaches include the targeting of cancer antigens through monoclonal antibodies or through adoptive transfer of ex vivo engineered T cells (e.g., which contain chimeric antigen receptors or engineered T cell receptors). The present invention also provides methods for inducing immune responses in a subject using the compositions of the invention. Also provided are methods for reducing a tumor burden in a subject using the compositions of the invention. The present invention also provides immune cells engineered to include one or more polypeptides, polynucleotides, or vectors of the present invention. The cells may be immune effector cells, including T cells such as cytotoxic T cells, helper T cells, memory T cells, regulatory T cells, natural killer (NK) cells, NK T cells, cytokine-induced killer (CIK) cells, cytotoxic T lymphocytes (CTLs), and tumor infiltrating lymphocytes (TILs). The engineered cell may be used for adoptive cell transfer for treating a disease (e.g., a cancer).

In some embodiments, pharmaceutical compositions, biocircuits, biocircuit components, effector modules including their SREs or payloads of the present invention may be used in the modulation or alteration or exploitation of the immune system to target one or more cancers. This approach may also be considered with other such biological approaches, e.g., immune response modifying therapies such as the administration of interferons, interleukins, colony-stimulating factors, other monoclonal antibodies, vaccines, gene therapy, and nonspecific immunomodulating agents are also envisioned as anti-cancer therapies to be combined with the pharmaceutical compositions, biocircuits, biocircuit components, effector modules including their SREs or payloads of the present invention.

Cancer immunotherapy refers to a diverse set of therapeutic strategies designed to induce the patient's own immune system to fight the cancer. In some embodiments, pharmaceutical compositions, biocircuits, biocircuit components, effector modules including their SREs or payloads of the present invention are designed as immune-oncology therapeutics.

In some embodiments, cells which are genetically modified to express at least one biocircuit system, effector module, DD, and/or payload of interest (immunotherapeutic agent) may be used for adoptive cell therapy (ACT). As used herein, Adoptive cell transfer refers to the administration of immune cells (from autologous, allogenic or genetically modified hosts) with direct anticancer activity. ACT has shown promise in clinical application against malignant and infectious disease. For example, T cells genetically engineered to recognize CD19 have been used to treat follicular B cell lymphoma (Kochenderfer et al., *Blood,* 2010, 116: 4099-4102; and Kochenderfer and Rosenberg, *Nat Rev Clin Oncol.,* 2013, 10(5): 267-276) and ACT using autologous lymphocytes genetically-modified to express anti-tumor T cell receptors has been used to treat metastatic melanoma (Rosenberg and Dudley, *Curr. Opin. Immunol.* 2009, 21: 233-240).

Immune cells for adoptive cell therapy may be selected from but not limited to selected from a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell, a human embryonic stem cell, a mesenchymal stem cell, a hematopoietic stem cell, or a mixture thereof.

There are several types of cellular immunotherapies, including tumor infiltrating lymphocyte (TIL) therapy, genetically engineered T cells bearing chimeric antigen receptors (CARs), and recombinant TCR technology. In some embodiments, the compositions of the present invention may be utilized to alter TIL (tumor infiltrating lymphocyte) populations in a subject. In one embodiment, any of the payloads described herein may be utilized to change the ratio of CD4 positive cells to CD8 positive populations. In some embodiments, TILs may be sorted ex vivo and engineered to express any of the cytokines described herein. Payloads of the invention may be used to expand CD4 and/or CD8 populations of TILs to enhance TIL mediated immune response.

In one embodiment, the chimeric antigen receptor (CAR) of the present invention may be a conditionally active CAR. A wild type protein or domain thereof, such as those described herein may be used to generate a conditionally active biologic protein which are reversibly or irreversibly inactivated at the wild type normal physiological conditions as well as to such conditionally active biologic proteins and domains and uses of such conditional active biologic proteins and domains are provided. Such methods and conditionally active proteins are taught in, for example, International Publication No. WO2016033331, the contents of which are incorporated herein by reference in their entirety. As a non-limiting example, the CAR comprises at least one antigen specific targeting region evolved from a wild type protein or a domain thereof and one or more of a decrease in activity in the assay at the normal physiological condition compared to the antigen specific targeting region of the wild-type protein or a domain thereof, and an increase in activity in the assay under the aberrant condition compared to the antigen specific targeting region of the wild-type protein or a domain thereof.

According to the present invention, the biocircuits and systems may be used in the development and implementation of cell therapies such as adoptive cell therapy. Certain effector modules useful in cell therapy are given in FIGS. 7-12. The biocircuits, their components, effector modules and their SREs and payloads may be used in cell therapies to effect TCR removal-TCR gene disruption, TCR engineering, to regulate epitope tagged receptors, in APC platforms for stimulating T cells, as a tool to enhance ex vivo APC stimulation, to improve methods of T cell expansion, in ex vivo stimulation with antigen, in TCR/CAR combinations, in the manipulation or regulation of TILs, in allogeneic cell therapy, in combination T cell therapy with other treatment lines (e.g. radiation, cytokines), to encode engineered TCRs, or modified TCRs, or to enhance T cells other than TCRs (e.g. by introducing cytokine genes, genes for the checkpoint inhibitors PD1, CTLA4).

In some embodiments, improved response rates are obtained in support of cell therapies.

Expansion and persistence of cell populations may be achieved through regulation or fine tuning of the payloads, e.g., the receptors or pathway components in T cells, NK cells or other immune-related cells. In some embodiments, biocircuits, their components, SREs or effector modules are designed to spatially and/or temporally control the expression of proteins which enhance T-cell or NK cell response. In some embodiments, biocircuits, their components, SREs or effector modules are designed to spatially and/or temporally control the expression of proteins which inhibit T-cell or NK cell response.

Provided herein are methods for use in adoptive cell therapy. The methods involve preconditioning a subject in need thereof, modulating immune cells with SRE, biocircuits and compositions of the present invention, administering to a subject, engineered immune cells expressing compositions of the invention and the successful engraftment of engineered cells within the subject.

In some embodiments, SREs, biocircuits and compositions of the present invention may be used to minimize preconditioning regimens associated with adoptive cell therapy. As used herein "preconditioning" refers to any therapeutic regimen administered to a subject in order to improve the outcome of adoptive cell therapy. Preconditioning strategies include, but are not limited to total body irradiation and/or lymphodepleting chemotherapy. Adoptive therapy clinical trials without preconditioning have failed to demonstrate any clinical benefit, indicating its importance in ACT. Yet, preconditioning is associated with significant toxicity and limits the subject cohort that is suitable for ACT. In some instances, immune cells for ACT may be engineered to express cytokines such as IL12 and IL15 as payload using SREs of the present invention to reduce the need for preconditioning (Pengram et al. (2012) Blood 119 (18): 4133-41; the contents of which are incorporated by reference in their entirety).

In some embodiments, the neurotoxicity may be associated with CAR or TIL therapy. Such neurotoxicity may be associated CD19-CARs. Toxicity may be due to excessive T cell infiltration into the brain. In some embodiments, neurotoxicity may be alleviated by preventing the passage of T cells through the blood brain barrier. This can be achieved by the targeted gene deletion of the endogenous alpha-4 integrin inhibitors such as tysabri/natalizumab may also be useful in the present invention.

In some embodiments, the effector modules may encode one or more cytokines. In some embodiments, the cytokine is IL15. Effector modules encoding IL15 may be designed to induce proliferation in cytotoxic populations and avoid stimulation of T regs. In other cases, the effector modules which induce proliferation in cytotoxic populations may also stimulate NK and NKT cells.

In some embodiments, effector modules may encode, or be tuned or induced to produce, one or more cytokines for expansion of cells in the biocircuits of the invention. In such cases the cells may be tested for actual expansion. Expansion may be at least 5%, 10%, 20%, 30%, 40%, 50%, 60%, 70%, 80%, 90% or more.

In some embodiments, the tumor microenvironment may be remodeled using a biocircuit containing an effector module encoding IL17.

In some embodiments, biocircuits, their components, SREs or effector modules are designed to modulate Tregs to attenuate autoimmune disorders. In such a case, IL2 may be regulated using a singly tuned module or one having multiple tuned features as described herein.

In some embodiments, immune cells for ACT may be dendritic cells, T cells such as $CD8^+$ T cells and $CD4^+$ T cells, natural killer (NK) cells, NK T cells, Cytotoxic T lymphocytes (CTLs), tumor infiltrating lymphocytes (TILs), lymphokine activated killer (LAK) cells, memory T cells, regulatory T cells (Tregs), helper T cells, cytokine-induced killer (CIK) cells, and any combination thereof. In other embodiments, immune stimulatory cells for ACT may be generated from embryonic stem cell (ESC) and induced pluripotent stem cell (iPSC). In some embodiments, autologous or allogeneic immune cells are used for ACT.

In some embodiments, cells used for ACT may be T cells engineered to express T cell receptors (TCRs) with new specificities or CARs comprising an antigen-binding domain specific to an antigen on tumor cells of interest. In other embodiments, cells used for ACT may be NK cells engineered to express CARs comprising an antigen-binding domain specific to an antigen on tumor cells of interest. In addition to adoptive transfer of genetically modified T cells (e.g., CAR T cells) for immunotherapy, alternate types of CAR-expressing leukocytes, either alone, or in combination with CAR T cells may be used for adoptive immunotherapy. In one example, a mixture of T cells and NK cells may be used for ACT. The expression level of CARs in T cells and NK cells, according to the present invention, is tuned and controlled by a small molecule that binds to the DD(s) operably linked to the CAR in the effector module.

In some embodiments, NK cells engineered to express the present compositions may be used for ACT. NK cell activation induces perforin/granzyme-dependent apoptosis in target cells. NK cell activation also induces cytokine secretion such as IFN γ, TNF-α and GM-CSF. These cytokines enhance the phagocytic function of macrophages and their antimicrobial activity, and augment the adaptive immune response via up-regulation of antigen presentation by antigen presenting cells such as dendritic cells (DCs) (Reviewed by Vivier et al., *Nat. Immunol.*, 2008, 9(5): 503-510).

Other examples of genetic modification may include the introduction of chimeric antigen receptors (CARs) and the down-regulation of inhibitory NK cell receptors such as NKG2A. Examples of CARs include, but are not limited to, CD19 and CD20 specific CARs against B cell malignancies, CARs targeting CD33 on leukemia cells, CS1 CAR and CD138 CAR on myeloma cells, GD2 CAR on neuroblastoma cells, Her2/Neu and erbB2 on breast cancer cells, carcinoembryonic antigen (CEA) on colon cancers, EpCAM on epithelial tumors, GPA7 on melanoma, NKG2D ligand on leukemia and solid tumors, and TRAIL R1 on various tumor targets. The CARs may be POIs of the effector modules and regulated by the binding of the DD with its corresponding ligand.

In another example, NK cells for ACT may be modified to express an effector module comprising the high-affinity CD16-158V polymorphism (HA-CD16) which augments NK cell mediated antibody dependent cell cytotoxicity (ADCC) against tumors. Infusion of NK cells genetically modified to express HA-CD16 could be used as a strategy to improve the efficacy of antibody-based therapies for cancer patients.

NK cells may also be genetically reprogrammed to circumvent NK cell inhibitory signals upon interaction with tumor cells. For example, using CRISPR, ZFN, or TALEN to genetically modify NK cells to silence their inhibitory receptors may enhance the anti-tumor capacity of NK cells.

Immune cells can be isolated and expanded ex vivo using a variety of methods known in the art. For example, methods of isolating and expanding cytotoxic T cells are described in U.S. Pat. Nos. 6,805,861 and 6,531,451; US Patent Publication No.: US20160348072A1 and International Patent Publication NO: WO2016168595A1; the contents of each of which are incorporated herein by reference in their entirety. Isolation and expansion of NK cells is described in US Patent Publication NO.: US20150152387A1, U.S. Pat. No. 7,435,596; and Oyer, J. L. (2016). Cytotherapy. 18(5):653-63; the contents of each of which are incorporated by reference herein in its entirety. Specifically, human primary NK cells may be expanded in the presence of feeder cells e.g. a myeloid cell line that has been genetically modified to express membrane bound IL15, IL21, IL12 and 4-1BBL.

In some instances, sub populations of immune cells may be enriched for ACT. Methods for immune cell enrichment are taught in International Patent Publication NO.: WO2015039100A1. In another example, T cells positive for B and T lymphocyte attenuator marker BTLA) may be used to enrich for T cells that are anti-cancer reactive as described in U.S. Pat. No. 9,512,401 (the content of each of which are incorporated herein by reference in their entirety).

In some embodiments, immune cells for ACT may be depleted of select sub populations to enhance T cell expansion. For example, immune cells may be depleted of Foxp3+T lymphocytes to minimize the ant-tumor immune response using methods taught in US Patent Publication NO.: US 20160298081A1; the contents of which are incorporated by reference herein in their entirety.

In some embodiments, activation and expansion of T cells for ACT is achieved antigenic stimulation of a transiently expressed Chimeric Antigen Receptor (CAR) on the cell surface. Such activation methods are taught in International Patent NO.: WO2017015427, the content of which are incorporated by reference herein in their entirety.

In some embodiments, immune cells may be activated by antigens associated with antigen presenting cells (APCs). In some embodiments, the APCs may be dendritic cells, macrophages or B cells that antigen specific or nonspecific. The APCs may autologous or homologous in their organ. In some embodiments the APCs may be artificial antigen presenting cells (aAPCs) such as cell based aAPCs or acellular aAPCs. Cell based aAPCs are may be selected from either genetically modified allogeneic cells such as human erythroleukemia cells or xenogeneic cells such as murine fibroblasts and Drosophila cells. Alternatively, the APCs maybe be acellular wherein the antigens or costimulatory domains are presented on synthetic surfaces such as latex beads, polystyrene beads, lipid vesicles or exosomes.

In some embodiments, adoptive cell therapy is carried out by autologous transfer, wherein the cells are derived from a subject in need of a treatment and the cells, following isolation and processing are administered to the same subject. In other instances, ACT may involve allogenic transfer wherein the cells are isolated and/or prepared from a donor subject other than the recipient subject who ultimately receives cell therapy. The donor and recipient subject may be genetically identical, or similar or may express the same HLA class or subtype.

In some embodiments, the multiple immunotherapeutic agents introduced into the immune cells for ACT (e.g., T cells and NK cells) may be controlled by the same biocircuit system. In one example, a cytokine such as IL12 and a CAR construct such as CD19 CAR are linked to the same hDHFR destabilizing domain. The expression of IL12 and CD19 CAR is tuned using TMP simultaneously. In other embodiments, the multiple immunotherapeutic agents introduced into the immune cells for ACT (e.g., T cells and NK cells) may be controlled by different biocircuit systems. In one example, a cytokine such as IL12 and a CAR construct such as CD19 CAR are linked to different DDs in two separate effector modules, thereby can be tuned separately using different stimuli. In another example, a suicide gene and a CAR construct may be linked to two separate effector modules.

Following genetic modulation using SREs, biocircuits and compositions of the invention, cells are administered to the subject in need thereof. Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al; U.S. Pat. No. 4,690,915 to Rosenberg; Rosenberg (2011) Nat Rev Clin Oncol. 8(10): 577-85). See, e.g., Themeli et al. (2013) Nat Biotechnol. 31(10): 928-933; Tsukahara et al. (2013) Biochem Biophys Res Commun 438(1): 84-9; Davila et al. (2013) PLoS ONE 8(4): e61338; the contents of each of which are incorporated herein by reference in their entirety.

In some embodiments, immune cells for ACT may be modified to express one or more immunotherapeutic agents which facilitate immune cells activation, infiltration, expansion, survival and anti-tumor functions. The immunotherapeutic agents may be a second CAR or TCR specific to a different target molecule; a cytokine or a cytokine receptor; a chimeric switch receptor that converts an inhibitory signal to a stimulatory signal; a homing receptor that guides adoptively transferred cells to a target site such as the tumor tissue; an agent that optimizes the metabolism of the immune cell; or a safety switch gene (e.g., a suicide gene) that kills activated T cells when a severe event is observed after adoptive cell transfer or when the transferred immune cells are no-longer needed.

In some embodiments, immune cells used for adoptive cell transfer can be genetically manipulated to improve their persistence, cytotoxicity, tumor targeting capacity, and ability to home to disease sites in vivo, with the overall aim of further improving upon their capacity to kill tumors in cancer patients. One example is to introduce effector modules of the invention comprising cytokines such as gamma-cytokines (IL2 and IL15) into immune cells to promote immune cell proliferation and survival. Transduction of cytokine genes (e.g., gamma-cytokines IL2 and EL15) into cells will be able to propagate immune cells without addition of exogenous cytokines and cytokine expressing NK cells have enhanced tumor cytotoxicity.

Another example includes the use of genetic modification for directing the infused NK cells to proper tumor tissues. NK cells may be genetically engineered with an effector module that encodes the CCR7 receptor to improve their migration toward one of its ligands CCL19. Other strategies may involve utilizing chemokine receptors, such as CXCR3 to improve NK cell migration to inflamed tissues, such as those infiltrated with metastatic tumors.

NK cells may be modified to become insensitive to suppressive cytokines such as TGF-$\beta$, thereby preserving their cytotoxicity. For example, NK cells can be genetically modified to express the dominant negative mutant form of TGF-$\beta$ type II receptor (DNTβRII) on their surface that render NK cells resistant to the suppressive effects of TGF-$\beta$.

In some embodiments, biocircuits, their components, SREs or effector modules are designed to be significantly less immunogenic than other biocircuits or switches in the art.

As used herein, "significantly less immunogenic" refers to a detectable decrease in immunogenicity. In another embodiment, the term refers to a fold decrease in immunogenicity. In another embodiment, the term refers to a decrease such that an effective amount of the biocircuits, their components, SREs or effector modules which can be administered without triggering a detectable immune response. In another embodiment, the term refers to a decrease such that the biocircuits, their components, SREs or effector modules can be repeatedly administered without eliciting an immune response. In another embodiment, the decrease is such that the biocircuits, their components, SREs or effector modules can be repeatedly administered without eliciting an immune response.

In another embodiment, the biocircuits, their components, SREs or effector modules is 2-fold less immunogenic than its unmodified counterpart or reference compound. In another embodiment, immunogenicity is reduced by a 3-fold factor. In another embodiment, immunogenicity is reduced by a 5-fold factor. In another embodiment, immunogenicity is reduced by a 7-fold factor. In another embodiment, immunogenicity is reduced by a 10-fold factor. In another embodiment, immunogenicity is reduced by a 15-fold factor. In another embodiment, immunogenicity is reduced by a fold factor. In another embodiment, immunogenicity is reduced by a 50-fold factor. In another embodiment, immunogenicity is reduced by a 100-fold factor. In another embodiment, immunogenicity is reduced by a 200-fold factor. In another embodiment, immunogenicity is reduced by a 500-fold factor. In another embodiment, immunogenicity is reduced by a 1000-fold factor. In another embodiment, immunogenicity is reduced by a 2000-fold factor. In another embodiment, immunogenicity is reduced by another fold difference.

Methods of determining immunogenicity are well known in the art, and include, e.g. measuring secretion of cytokines (e.g. IL12, IFNalpha, TNF-alpha, RANTES, MIP-1alpha or beta, IL6, IFN beta, or IL8), measuring expression of DC activation markers (e.g. CD83, HLA-DR, CD80 and CD86), or measuring ability to act as an adjuvant for an adaptive immune response.

The present invention provides method of inducing an immune response in a cell. As used herein the term "immune response" refers to the activity of the cells of the immune system in response to stimulus, or an antigen. In some embodiments, the antigen may be a cancer antigen. In some aspects, the methods of inducing an immune response may involve administering to the cell, a therapeutically effective amount of any of the compositions described herein. In one aspect, the method may involve administering the pharmaceutical compositions described herein. In one aspect, the method may involve administering the polynucleotides, vectors. In some embodiments, induction of the immune response occurs due to the expression and or function of the immunotherapeutic agents described herein. Methods of inducing immune response further may involve administering to the cell, an effective amount of the stimulus to tune the expression of the immunotherapeutic agent. In some embodiments, the immunotherapeutic agent is capable of inducing an immune response in response to the stimulus. The induction of the immune response may occur in a cell within a subject i.e. in vivo, ex vivo or in vitro. The induction of an immune response may be evaluated by measuring the release of cytokine such as IL2 and IFNγ from the cells. In some embodiments, the induction of an immune response may be measured by evaluating the cell surface markers such as but not limited to CD3, CD4, CD8, CD 14, CD20, CD1 b, CD16, CD45 and HLA-DR, CD 69, CD28, CD44, IFNgamma. Examples of cell surface markers for antigen presenting cells include, but are not limited to, MHC class I, MHC Class II, CD40, CD45, B7-1, B7-2, IFN γ receptor and IL2 receptor, ICAM-1 and/or Fcγ receptor. Examples of cell surface markers for dendritic cells include, but are not limited to, MHC class I, MHC Class II, B7-2, CD18, CD29, CD31, CD43, CD44, CD45, CD54, CD58, CD83, CD86, CMRF-44, CMRF-56, DCIR and/or Dectin-1 and the like; while in some cases also having the absence of CD2, CD3, CD4, CD8, CD14, CD15, CD16, CD 19, CD20, CD56, and/or CD57. Examples of cell surface markers for NK cells include, but are not limited to, CCL3, CCL4, CCL5, Granulysin, Granzyme B, Granzyme K, IL10, IL22, IFNg, LAP, Perforin, and TNFa.

2. Cancer Vaccines

In some embodiments, biocircuits, effector modules, payloads of interest (immunotherapeutic agents), vectors, cells and compositions of the present invention may be used for cancer vaccines. In one aspect, dendritic cells are modified to express the compositions of the invention and used as cancer vaccines.

In some embodiments, cancer vaccine may comprise peptides and/or proteins derived from tumor associated antigen (TAA). Such strategies may be utilized to evoke an immune response in a subject, which in some instances may be a cytotoxic T lymphocyte (CTL) response. Peptides used for cancer vaccines may also modified to match the mutation profile of a subject. For example, EGFR derived peptides with mutations matched to the mutations found in the subject in need of therapy have been successfully used in patients with lung cancer (Li F et al. (2016) Oncoimmunology. October 7; 5(12): e1238539; the contents of which are incorporated herein by reference in their entirety).

In one embodiment, cancer vaccines of the present invention may superagonist altered peptide ligands (APL) derived from TAAs. These are mutant peptide ligands deviate from the native peptide sequence by one or more amino acids, which activate specific CTL clones more effectively than native epitopes. These alterations may allow the peptide to bind better to the restricting Class I MHC molecule or interact more favorably with the TCR of a given tumor-specific CTL subset. APLs may be selected using methods taught in US Patent Publication NO.: US20160317633A1, the contents of which are incorporated herein by reference in their entirety.

3. Tumor Microenvironment (TME)

In some embodiments, biocircuits, their components, SREs or effector modules are designed to reshape the tumor microenvironment in order to extend utility of the biocircuit or a pharmaceutical composition beyond direct cell killing.

In some embodiments, biocircuits, their components, SREs or effector modules are designed to reduce, mitigate or eliminate the CAR cytokine storm. In some embodiments, such reduction, mitigation and/or elimination occurs in solid tumors or tumor microenvironments.

In some embodiments, biocircuits, effector modules, payloads of interest (immunotherapeutic agents), vectors, cells and pharmaceutical compositions of the present invention may be used to convert the immunosuppressive microenvironment to increase immune responses.

In some embodiments, the invention provides methods for converting the inhibitory immunoregulatory signals from immunosuppressive cytokines secreted by cancer cells or the surrounding tumor stroma into stimulatory signals using compositions of the invention. Immunosuppressive cytokines include without limitation, IL13, IL4, TGF-beta, IL6, IL8, and IL10. In one aspect, the genetically modified tumor-specific T cells (e.g., CAR T cells) or T cells with native tumor specificity may be further engineered to express an effector module comprising a chimeric switch receptor that binds to inhibitory/suppressive cytokines and converts their intracellular consequences to an immunostimulatory/activating signal, thus improving the efficacy of tumor-specific T cells. The chimeric switch receptor is composed of the extracellular domains of an inhibitory cytokine receptor (e.g., IL13R, IL4R, IL10R, TGFβR1/ALK5, TGFβR2, and TGFβR3/β-glycan) fused with the intracellular signal transducing domains derived from stimulatory cytokine receptors such as IL2R (i.e., IL2Rα/CD25, IL2Rβ/CD122, and common γ chain receptor/CD132 which is shared by various cytokine receptors) and/or IL7R (IL7Rα/CD127, common γ chain receptor/CD132). These manipulations render tumor specific T cells or CAR T cells resistant to the suppressive tumor microenvironment.

In some embodiments, the present invention provides methods to abrogate the immunosuppressive effects produced by myeloid derived suppressor cells (MDSCs). Tumor cells secrete indoleamine 2,3-dioxygenase (IDO) which promotes immunosuppression through the recruitment of MDSCs. The immunosuppressive environment is further promoted by the MDSCs through nitric oxide synthase (NOS) and arginase 1 (ARG1) which can degrade extracellular arginine. Amino acid deprivation within the tumor microenvironment suppresses T cell anti-tumor activity. In some embodiments, payloads of the present invention may comprise inhibitors of NOS, ARG1 and tryptophan metabolism pathway such as IDO. In one embodiment, the payload may include inhibitors of colony stimulating factor receptor 1 (CSFR1) which required for the proliferation and function of MDSCs.

In some embodiments, dominant negative mutants of inhibitory co receptor such as PD-1, CTLA-4, LAG-3, TIM-3, KIRs, or BTLA may be utilized as payloads of the invention to overcome inhibitory signals in the tumor microenvironment.

4. Combination Treatments

In some embodiments, it is desirable to combine compositions, vectors and cells of the invention for administration to a subject. Compositions of the invention comprising different immunotherapeutic agents may be used in combination for enhancement of immunotherapy.

Immunotherapeutic Agents

In some embodiments, it is desirable to combine compositions of the invention with adjuvants, that can enhance the potency and longevity of antigen-specific immune responses. Adjuvants used as immunostimulants in combination therapy include biological molecules or delivery carriers that deliver antigens. As non-limiting examples, the compositions of the invention may be combined with biological adjuvants such as cytokines, Toll Like Receptors, bacterial toxins, and/or saponins. In other embodiments, the compositions of the present invention may be combined with delivery carriers. Exemplary delivery carriers include, polymer microspheres, immune stimulating complexes, emulsions (oil-in-water or water-in-oil), aluminum salts, liposomes or virosomes.

In some embodiments, immune effector cells modified to express biocircuits, effector modules, DDs and payloads of the invention may be combined with the biological adjuvants described herein. Dual regulation of CAR and cytokines and ligands to segregate the kinetic control of target-mediated activation from intrinsic cell T cell expansion. Such dual regulation also minimizes the need for pre-conditioning regimens in patients. As a non-limiting example, DD regulated CAR e.g. CD19 CAR may be combined with cytokines e.g. IL12 to enhance the anti-tumor efficacy of the CAR (Pegram H. J., et al. Tumor-targeted T cells modified to secrete IL12 eradicate systemic tumors without need for prior conditioning. Blood. 2012; 119:4133-41; the contents of each of which are incorporated herein by reference in their entirety). As another non-limiting example, Merchant et al. combined dendritic cell-based vaccinations with recombinant human IL7 to improve outcome in high-risk pediatric sarcomas patients (Merchant, M. S. et. al. Adjuvant immunotherapy to Improve Outcome in High-Risk Pediatric Sarcomas. Clin Cancer Res. 2016. 22(13):3182-91; the contents of each of which are incorporated herein by reference in their entirety).

In some embodiments, immune effector cells modified to express one or more antigen-specific TCRs or CARs may be combined with compositions of the invention comprising immunotherapeutic agents that convert the immunosuppressive tumor microenvironment.

In one aspect, effector immune cells modified to express CARs specific to different target molecules on the same cell may be combined. In another aspect, different immune cells modified to express the same CAR construct such as NK cells and T cells may be used in combination for a tumor treatment, for instance, a T cell modified to express a CD19 CAR may be combined with a NK cell modified to express the same CD19 CAR to treat B cell malignancy.

In other embodiments, immune cells modified to express CARs may be combined with checkpoint blockade agents.

In some embodiments, immune effector cells modified to expressed biocircuits, effector modules, DDs and payloads of the invention may be combined with cancer vaccines of the invention.

In some embodiments, an effector module comprising a CAR may be used in combination with an effector module comprising a cytokine, or an effector module comprising a safety switch, or an effector module comprising a metabolic factor, or an effector module comprising a homing receptor.

In one embodiment, an effector module comprising a CD19 CAR may be used in combination with amino pyrimidine derivatives such as the Burkit's tyrosine receptor kinase (BTK) inhibitor using methods taught in International Patent Application NO.: WO2016164580, the contents of which are incorporated herein by reference in their entirety.

Cancer

In some embodiments, methods of the invention may include combination of the compositions of the invention with other agents effective in the treatment of cancers, infection diseases and other immunodeficient disorders, such as anti-cancer agents. As used herein, the term "anti-cancer agent" refers to any agent which is capable of negatively affecting cancer in a subject, for example, by killing cancer cells, inducing apoptosis in cancer cells, reducing the growth rate of cancer cells, reducing the incidence or number of metastases, reducing tumor size, inhibiting tumor growth, reducing the blood supply to a tumor or cancer cells, promoting an immune response against cancer cells or a tumor, preventing or inhibiting the progression of cancer, or increasing the lifespan of a subject with cancer.

In some embodiments, anti-cancer agent or therapy may be a chemotherapeutic agent, or radiotherapy, immunotherapeutic agent, surgery, or any other therapeutic agent which, in combination with the present invention, improves the therapeutic efficacy of treatment.

In some embodiments, compositions of the present invention may be used in combination with immunotherapeutics other than the inventive therapy described herein, such as antibodies specific to some target molecules on the surface of a tumor cell.

Exemplary chemotherapies include, without limitation, Acivicin; Aclarubicin; Acodazole hydrochloride; Acronine; Adozelesin; Aldesleukin; Altretamine; Ambomycin; Ametantrone acetate; Amsacrine; Anastrozole; Anthramycin; Asparaginase; Asperrin, Sulindac, Curcumin, alkylating agents including: Nitrogen mustards such as mechlorethamine, cyclophosphamide, ifosfamide, melphalan and chlorambucil; nitrosoureas such as carmustine (BC U), lomustine (CCNU), and semustine (methyl-CC U); thylenimines/methylmelamine such as thriethylenemelamine (TEM), triethylene, thiophosphoramide (thiotepa), hexamethylmelamine (HMM, altretamine); alkyl sulfonates such as busulfan; triazines such as dacarbazine (DTIC); antimetabolites including folic acid analogs such as methotrexate and trimetrexate, pyrrolidine analogs such as 5-fluorouracil, fluorodeoxyuridine, gemcitabine, cytosine arabinoside (AraC, cytarabine), 5-azacytidine, 2,2'-difluorodeoxycytidine, purine analogs such as 6-mercaptopurine, 6-thioguanine, azathioprine, 2'-deoxycoformycin (pentostatin), erythrohydroxynonyladenine (EHNA), fludarabine phosphate, and 2-chlorodeoxyadenosine (cladribine, 2-CdA); natural products including antimitotic drugs such as paclitaxel, vinca alkaloids including vinblastine (VLB), vincristine, and vinorelbine, taxotere, estramustine, and estramustine phosphate; epipodophylotoxins such as etoposide and teniposide; antibiotics, such as actimomycin D, daunomycin (rubidomycin), doxorubicin, mitoxantrone, idarubicin, bleomycins, plicamycin (mithramycin), mitomycinC, and actinomycin; enzymes such as L-asparaginase, cytokines such as interferon (IFN)-gamma, tumor necrosis factor (TNF)-alpha, TNF-beta and GM-CSF, anti-angiogenic factors, such as angiostatin and endostatin, inhibitors of FGF or VEGF such as soluble forms of receptors for angiogenic factors, including soluble VGF/VEGF receptors, platinum coordination complexes such as cisplatin and carboplatin, anthracenediones such as mitoxantrone, substituted urea such as hydroxyurea, methylhydrazine derivatives including N-methylhydrazine (MIFf) and procarbazine, adrenocortical suppressants such as mitotane (o,p'-DDD) and aminoglutethimide; hormones and antagonists including adrenocorticosteroid antagonists such as prednisone and equivalents, dexamethasone and aminoglutethimide; progestin such as hydroxyprogesterone caproate, medroxyprogesterone acetate and megestrol acetate; estrogen such as diethylstilbestrol and ethinyl estradiol equivalents; antiestrogen such as tamoxifen; androgens including testosterone propionate and fluoxymesterone/equivalents; antiandrogens such as flutamide, gonadotropin-releasing hormone analogs and leuprolide; non-steroidal antiandrogens such as flutamide; kinase inhibitors, histone deacetylase inhibitors, methylation inhibitors, proteasome inhibitors, monoclonal antibodies, oxidants, anti-oxidants, telomerase inhibitors, BH3 mimetics, ubiquitin ligase inhibitors, stat inhibitors and receptor tyrosin kinase inhibitors such as imatinib mesylate (marketed as Gleevac or Glivac) and erlotinib (an EGF receptor inhibitor) now marketed as Tarveca; anti-virals such as oseltamivir phosphate, Amphotericin B, and palivizumab; Sdi 1 mimetics; Semustine; Senescence derived inhibitor 1; Sparfosic acid; Spicamycin D; Spiromustine; Splenopentin; Spongistatin 1; Squalamine; Stipiamide; Stromelysin inhibitors; Sulfinosine; Superactive vasoactive intestinal peptide antagonist; Velaresol; Veramine; Verdins; Verteporfin; Vinorelbine; Vinxaltine; Vitaxin; Vorozole; Zanoterone; Zeniplatin; Zilascorb; and Zinostatin stimalamer; PI3Kβ small-molecule inhibitor, GSK2636771; pan-PI3K inhibitor (BKM120); BRAF inhibitors. Vemurafenib (Zelboraf) and dabrafenib (Tafinlar); or any analog or derivative and variant of the foregoing.

In one embodiment, the invention further relates to the use of pharmaceutical compositions, biocircuits, biocircuit components, effector modules including their SREs or payloads of the present invention for treating one or more forms of cancer, in combination with other pharmaceuticals and/or other therapeutic methods, e.g., with known pharmaceuticals and/or known therapeutic methods, such as, for example, those which are currently employed for treating these disorders. For example, the pharmaceutical compositions, biocircuits, biocircuit components, effector modules including their SREs or payloads of the present invention can also be administered in conjunction with one or more additional anti-cancer treatments, such as biological, chemotherapy and radiotherapy. Accordingly, a treatment can include, for example, imatinib (Gleevac), all-trans-retinoic acid, a monoclonal antibody treatment (gemtuzumab, ozogamicin), chemotherapy (for example, chlorambucil, prednisone, prednisolone, vincristine, cytarabine, clofarabine, farnesyl transferase inhibitors, decitabine, inhibitors of MDR1), rituximab, interferon-α, anthracycline drugs (such as daunorubicin or idarubicin), L-asparaginase, doxorubicin, cyclophosphamide, doxorubicin, bleomycin, fludarabine, etoposide, pentostatin, or cladribine), bone marrow transplant, stem cell transplant, radiation therapy, anti-metabolite drugs (methotrexate and 6-mercaptopurine), or any of the antibodies taught herein such as those in Table 6 of the co-owned U.S. Provisional Patent Application No. 62/320,864 filed Apr. 11, 2016, 62/466,596 filed Mar. 3, 2017 and the International Publication WO2017/180587 (the contents of each of which are herein incorporated by reference in their entirety), or combinations thereof.

Radiotherapeutic agents and factors include radiation and waves that induce DNA damage for example, γ-irradiation, X-rays, UV-irradiation, microwaves, electronic emissions, radioisotopes, and the like. Therapy may be achieved by irradiating the localized tumor site with the above described forms of radiations. It is most likely that all of these factors effect a broad range of damage DNA, on the precursors of DNA, the replication and repair of DNA, and the assembly and maintenance of chromosomes. Dosage ranges for X-rays range from daily doses of 50 to 200 roentgens for prolonged periods of time (3 to 4 weeks), to single doses of 2000 to 6000 roentgens. Dosage ranges for radioisotopes vary widely, and depend on the half-life of the isotope, the strength and type of radiation emitted, and the uptake by the neoplastic cells.

Radiation therapy (also called radiotherapy, X-ray therapy, or irradiation) is the use of ionizing radiation to kill cancer cells and shrink tumors. Radiation therapy can be administered externally via external beam radiotherapy (EBRT) or internally via brachytherapy. The effects of radiation therapy are localized and confined to the region being treated. Radiation therapy may be used to treat almost every type of solid tumor, including cancers of the brain, breast, cervix, larynx, lung, pancreas, prostate, skin, stomach, uterus, or soft tissue sarcomas. Radiation is also used to treat leukemia and lymphoma.

In some embodiments, the chemotherapeutic agent may be an immunomodulatory agent such as lenalidomide (LEN). Recent studies have demonstrated that lenalidomide can enhance antitumor functions of CAR modified T cells (Otahal et al., *Oncoimmunology*, 2015, 5(4): e1115940). Some examples of anti-tumor antibodies include tocilizumab, siltuximab.

Chemotherapy is the treatment of cancer with drugs that can destroy cancer cells. In current usage, the term "chemotherapy" usually refers to cytotoxic drugs which affect rapidly dividing cells in general, in contrast with targeted therapy. Chemotherapy drugs interfere with cell division in various possible ways, e.g. with the duplication of DNA or the separation of newly formed chromosomes. Most forms of chemotherapy target all rapidly dividing cells and are not specific to cancer cells, although some degree of specificity may come from the inability of many cancer cells to repair DNA damage, while normal cells generally can.

Most chemotherapy regimens are given in combination. Exemplary chemotherapeutic agents include, but are not limited to, 5-FU Enhancer, 9-AC, AG2037, AG3340, Aggrecanase Inhibitor, Aminoglutethimide, Amsacrine (m-AMSA), Asparaginase, Azacitidine, Batimastat (BB94), BAY 12-9566, BCH-4556, Bis-Naphthalimide, Busulfan, Capecitabine, Carboplatin, Carmustaine+Polifepr Osan, cdk4/cdk2 inhibitors, Chlorambucil, CI-994, Cisplatin, Cladribine, CS-682, Cytarabine HCl, D2163, Dactinomycin, Daunorubicin HCl, DepoCyt, Dexifosamide, Docetaxel, Dolastain, Doxifluridine, Doxorubicin, DX8951f, E 7070, EGFR, Epirubicin, Erythropoietin, Estramustine phosphate sodium, Etoposide (VP16-213), Farnesyl Transferase Inhibitor, FK 317, Flavopiridol, Floxuridine, Fludarabine, Fluorouracil (5-FU), Flutamide, Fragyline, Gemcitabine, Hexamethylmelamine (HMM), Hydroxyurea (hydroxycarbamide), Ifosfamide, Interferon Alfa-2a, Interferon Alfa-2b, Interleukin-2, Irinotecan, ISI 641, Krestin, Lemonal DP 2202, Leuprolide acetate (LHRH-releasing factor analogue), Levamisole, LiGLA (lithium-gamma linolenate), Lodine Seeds, Lometexol, Lomustine (CCNU), Marimistat, Mechlorethamine HCl (nitrogen mustard), Megestrol acetate, Meglamine GLA, Mercaptopurine, Mesna, Mitoguazone (methyl-GAG; methyl glyoxal bis-guanylhydrazone; MGBG), Mitotane (o.p'-DDD), Mitoxantrone, Mitoxantrone HCl, MMI 270, MMP, MTA/LY 231514, Octreotide, ODN 698, OK-432, Oral Platinum, Oral Taxoid, Paclitaxel (TAXOL®), PARP Inhibitors, PD 183805, Pentostatin (2' deoxycoformycin), PKC 412, Plicamycin, Procarbazine HCl, PSC 833, Ralitrexed, RAS Farnesyl Transferase Inhibitor, RAS Oncogene Inhibitor, Semustine (methyl-CCNU), Streptozocin, Suramin, Tamoxifen citrate, Taxane Analog, Temozolomide, Teniposide (VM-26), Thioguanine, Thiotepa, Topotecan, Tyrosine Kinase, UFT (Tegafur/Uracil), Valrubicin, Vinblastine sulfate, Vindesine sulfate, VX-710, VX-853, YM 116, ZD 0101, ZD 0473/Anormed, ZD 1839, ZD 9331.

Other agents may be used in combination with compositions of the invention may also include, but not limited to, agents that affect the upregulation of cell surface receptors and their ligands such as Fas/Fas ligand, DR4 or DR5/TRAIL and GAP junctions, cytostatic and differentiation agents, inhibitors of cell adhesion such as focal adhesion kinase (FAKs) inhibitors and Lovastatin, or agents that increase the sensitivity of the hyper proliferative cells to apoptotic inducers such as the antibody C225.

The combinations may include administering the compositions of the invention and other agents at the same time or separately. Alternatively, the present immunotherapy may precede or follow the other agent/therapy by intervals ranging from minutes, days, weeks to months.

5. Therapeutic Uses

Provided in the present invention is a method of reducing a tumor volume or burden in a subject in need, the method comprising introducing into the subject a composition of the invention.

The present invention also provides methods for treating a cancer in a subject, comprising administering to the subject an effective amount of an immune effector cell genetically modified to express at least one effector module of the invention.

Cancer

Various cancers may be treated with pharmaceutical compositions, biocircuits, biocircuit components, effector modules including their SREs or payloads of the present invention. As used herein, the term "cancer" refers to any of various malignant neoplasms characterized by the proliferation of anaplastic cells that tend to invade surrounding tissue and metastasize to new body sites and refers to the pathological condition characterized by such malignant neoplastic growths. Cancers may be tumors or hematological malignancies, and include but are not limited to, all types of lymphomas/leukemias, carcinomas and sarcomas, such as those cancers or tumors found in the anus, bladder, bile duct, bone, brain, breast, cervix, colon/rectum, endometrium, esophagus, eye, gallbladder, head and neck, liver, kidney, larynx, lung, mediastinum (chest), mouth, ovaries, pancreas, penis, prostate, skin, small intestine, stomach, spinal marrow, tailbone, testicles, thyroid and uterus.

Types of carcinomas which may be treated with the compositions of the present invention include, but are not limited to, papilloma/carcinoma, choriocarcinoma, endodermal sinus tumor, teratoma, adenoma/adenocarcinoma, melanoma, fibroma, lipoma, leiomyoma, rhabdomyoma, mesothelioma, angioma, osteoma, chondroma, glioma, lymphoma/leukemia, squamous cell carcinoma, small cell carcinoma, large cell undifferentiated carcinomas, basal cell carcinoma and sinonasal undifferentiated carcinoma.

Types of carcinomas which may be treated with the compositions of the present invention include, but are not limited to, soft tissue sarcoma such as alveolar soft part sarcoma, angiosarcoma, dermatofibrosarcoma, desmoid tumor, desmoplastic small round cell tumor, extraskeletal chondrosarcoma, extraskeletal osteosarcoma, fibrosarcoma, hemangiopericytoma, hemangiosarcoma, Kaposi's sarcoma, leiomyosarcoma, liposarcoma, lymphangiosarcoma, lymphosarcoma, malignant fibrous histiocytoma, neurofibrosarcoma, rhabdomyosarcoma, synovial sarcoma, and Askin's tumor, Ewing's sarcoma (primitive neuroectodermal tumor), malignant hemangioendothelioma, malignant schwannoma, osteosarcoma, and chondrosarcoma.

As a non-limiting example, the carcinoma which may be treated may be Acute granulocytic leukemia, Acute lymphocytic leukemia, Acute myelogenous leukemia, Adenocarcinoma, Adenosarcoma, Adrenal cancer, Adrenocortical carcinoma, Anal cancer, Anaplastic astrocytoma, Angiosarcoma, Appendix cancer, Astrocytoma, Basal cell carcinoma, B-Cell lymphoma), Bile duct cancer, Bladder cancer, Bone cancer, Bowel cancer, Brain cancer, Brain stem glioma, Brain tumor, Breast cancer, Carcinoid tumors, Cervical cancer, Cholangiocarcinoma, Chondrosarcoma, Chronic lymphocytic leukemia, Chronic myelogenous leukemia, Colon cancer, Colorectal cancer, Craniopharyngioma, Cutaneous lymphoma, Cutaneous melanoma, Diffuse astrocytoma, Ductal carcinoma in situ, Endometrial cancer, Ependymoma, Epithelioid sarcoma, Esophageal cancer, Ewing sarcoma, Extrahepatic bile duct cancer, Eye cancer, Fallopian tube cancer, Fibrosarcoma, Gallbladder cancer, Gastric cancer, Gastrointestinal cancer, Gastrointestinal carcinoid cancer, Gastrointestinal stromal tumors, General, Germ cell tumor, Glioblastoma multiforme, Glioma, Hairy cell leukemia, Head and neck cancer, Hemangioendothelioma, Hodgkin lymphoma, Hodgkin's disease, Hodgkin's lymphoma, Hypopharyngeal cancer, Infiltrating ductal carcinoma, Infiltrating lobular carcinoma, Inflammatory breast cancer, Intestinal Cancer, Intrahepatic bile duct cancer, Invasive/infiltrating breast cancer, Islet cell cancer, Jaw cancer, Kaposi sarcoma, Kidney cancer, Laryngeal cancer, Leiomyosarcoma, Leptomeningeal metastases, Leukemia, Lip cancer, Liposarcoma, Liver cancer, Lobular carcinoma in situ, Low-grade astrocytoma, Lung cancer, Lymph node cancer, Lymphoma, Male breast cancer, Medullary carcinoma, Medulloblastoma, Melanoma, Meningioma, Merkel cell carcinoma, Mesenchymal chondrosarcoma, Mesenchymous, Mesothelioma, Metastatic breast cancer, Metastatic melanoma, Metastatic squamous neck cancer, Mixed gliomas, Mouth cancer, Mucinous carcinoma, Mucosal melanoma, Multiple myeloma, Nasal cavity cancer, Nasopharyngeal cancer, Neck cancer, Neuroblastoma, Neuroendocrine tumors, Non-Hodgkin lymphoma, Non-Hodgkin's lymphoma, Non-small cell lung cancer, Oat cell cancer, Ocular cancer, Ocular melanoma, Oligodendroglioma, Oral cancer, Oral cavity cancer, Oropharyngeal cancer, Osteogenic sarcoma, Osteosarcoma, Ovarian cancer, Ovarian epithelial cancer, Ovarian germ cell tumor, Ovarian primary peritoneal carcinoma, Ovarian sex cord stromal tumor, Paget's disease, Pancreatic cancer, Papillary carcinoma, Paranasal sinus cancer, Parathyroid cancer, Pelvic cancer, Penile cancer, Peripheral nerve cancer, Peritoneal cancer, Pharyngeal cancer, Pheochromocytoma, Pilocytic astrocytoma, Pineal region tumor, Pineoblastoma, Pituitary gland cancer, Primary central nervous system lymphoma, Prostate cancer, Rectal cancer, Renal cell cancer, Renal pelvis cancer, Rhabdomyosarcoma, Salivary gland cancer, Sarcoma, Sarcoma, bone, Sarcoma, soft tissue, Sarcoma, uterine, Sinus cancer, Skin cancer, Small cell lung cancer, Small intestine cancer, Soft tissue sarcoma, Spinal cancer, Spinal column cancer, Spinal cord cancer, Spinal tumor, Squamous cell carcinoma, Stomach cancer, Synovial sarcoma, T-cell lymphoma), Testicular cancer, Throat cancer, Thymoma/thymic carcinoma, Thyroid cancer, Tongue cancer, Tonsil cancer, Transitional cell cancer, Transitional cell cancer, Transitional cell cancer, Triple-negative breast cancer, Tubal cancer, Tubular carcinoma, Ureteral cancer, Ureteral cancer, Urethral cancer, Uterine adenocarcinoma, Uterine cancer, Uterine sarcoma, Vaginal cancer, and Vulvar cancer.

In some embodiments, the CARs of the present invention may be a CAR useful in the treatment of multiple myeloma such as a CS1 CAR, a CD38 CAR, a CD138 CAR, and a BCMA CAR. In some embodiments, the CARs of the present invention may be a CAR useful in the treatment of acute myeloid leukemia such as a CD33 CAR, a CD123 CAR, and a CLL1 CAR. In some embodiments, the CARs of the present invention may be a CAR useful in the treatment of T cell leukemia such as a CD5 CAR, and a CD7 CAR. In some embodiments, the CARs of the present invention may be a CAR useful in the treatment of solid tumors such a mesothelin CAR, a GD2 CAR, a GPC3 CAR, a Her2 CAR, an EGFR CAR, a Muc1 CAR, an EpCAM CAR, a PD-L1 CAR, a CEA CAR, a Muc16 CAR, a CD133 CAR, a CD171 CAR, a CD70 CAR, a CLD18 CAR, a cMET CAR, a EphA2 CAR, a FAP CAR, a Folate Receptor CAR, an IL13Ra2 CAR, an MG7 CAR, a PSMA CAR, a ROR1 CAR, and a VEGFR2 CAR.

The present invention also provides methods of reducing tumor burden in a subject. In some embodiments. As used herein, "tumor burden" refers to the number of cancer cells, or the amount of cancer in a subject. In some aspects tumor burden also refers to tumor load. In some embodiments, the tumor may be disseminated throughout the body of the subject. In one aspect, the tumor may be a liquid tumor such as leukemia or a lymphoma. The methods of reducing tumor burden may involve administering to the subject, a therapeutically effective amount of the immune cells. Immune cells may be engineered to express the compositions described herein. In some embodiments, the immune cells expressing the compositions of the invention may be administered to the subject via any of the routes of delivery described herein. Also provided herein are dosing regimens for administering the immune cells. In some embodiments, the subject may also be administered a therapeutically effective amount of the stimulus to tune the expression of the immunotherapeutic agent. In some aspects, the immunotherapeutic agents may be capable of reducing the tumor burden. Regimens for ligand/stimulus dosing are also provided. Reduction in tumor burden may be measured by any of the methods known in the art including tumor imaging, and measurement of marker proteins. In some aspects, bioluminescent imaging may be used to measure tumor burden. Bioluminescence imaging utilizes native light emission from bioluminescent proteins such as luciferase. Such bioluminescent proteins can participate in chemical reactions that release photons by the addition of suitable substrates. The release of photons can be captured by sensitive detection methods and quantified. Tumor cells may be engineered to express luciferase and the efficacy of the compositions described herein to reduce tumor burden may quantified by imaging. In some aspects, the tumor burden may be measured by the flux of photons (photons per sec). In some embodiments, photon flux positively correlates with tumor burden.

Diseases and Toxins

Various infectious diseases may be treated with pharmaceutical compositions, biocircuits, biocircuit components, effector modules including their SREs or payloads of the present invention. As used herein, the term "infectious disease" refers to any disorders caused by organisms such as bacteria, viruses, fungi or parasites. As a non-limiting example, the infectious disease may be Acute bacterial rhinosinusitis, 14-day measles, Acne, Acrodermatitis chronica atrophicans (ACA)-(late skin manifestation of latent Lyme disease), Acute hemorrhagic conjunctivitis, Acute hemorrhagic cystitis, Acute rhinosinusitis, Adult T-cell Leukemia-Lymphoma (ATLL), African Sleeping Sickness, AIDS (Acquired Immunodeficiency Syndrome), Alveolar hydatid, Amebiasis, Amebic meningoencephalitis, Anaplasmosis, Anthrax, Arboviral or parainfectious, Ascariasis-(Roundworm infections), Aseptic meningitis, Athlete's foot (*Tinea pedis*), Australian tick typhus, Avian Influenza, Babesiosis, Bacillary angiomatosis, Bacterial meningitis, Bacterial vaginosis, Balanitis, Balantidiasis, Bang's disease, Barmah Forest virus infection, Bartonellosis (Verruga *peruana*; Carrion's disease; Oroya fever), Bat Lyssavirus Infection, Bay sore (Chiclero's ulcer), Baylisascaris infection (Racoon roundworm infection), Beaver fever, Beef tapeworm, Bejel (endemic syphilis), Biphasic meningoencephalitis, Black Bane, Black death, Black *piedra*, Blackwater Fever, Blastomycosis, Blennorrhea of the newborn, Blepharitis, Boils, Bornholm disease (pleurodynia), *Borrelia miyamotoi* Disease, Botulism, Boutonneuse fever, Brazilian purpuric fever, Break Bone fever, Brill, Bronchiolitis, Bronchitis, Brucellosis (Bang's disease), Bubonic plague, Bullous impetigo, *Burkholderia mallei* (Glanders), *Burkholderia pseudomallei* (Melioidosis), Buruli ulcers (also Mycoburuli ulcers), Busse, Busse-Buschke disease (Cryptococcosis), California group encephalitis, Campylobacteriosis, Candidiasis, Canefield fever (Canicola fever; 7-day fever; Weil's disease; leptospirosis; canefield fever), Canicola fever, Capillariasis, Carate, Carbapenem-resistant Enterobacteriaceae (CRE), Carbuncle, Carrion's disease, Cat Scratch fever, Cave disease, Central Asian hemorrhagic fever, Central European tick, Cervical cancer, Chagas disease, Chancroid (Soft chancre), Chicago disease, Chickenpox (*varicella*), Chiclero's ulcer, Chikungunya fever, Chlamydial infection, Cholera, Chromoblastomycosis, Ciguatera, Clap, Clonorchiasis (Liver fluke infection), *Clostridium difficile* Infection, *Clostridium perfringens* (Epsilon Toxin), Coccidioidomycosis fungal infection (Valley fever; desert rheumatism), Coenurosis, Colorado tick fever, Condyloma *accuminata*, Condyloma *accuminata* (Warts), Condyloma *lata*, Congo fever, Congo hemorrhagic fever virus, Conjunctivitis, cowpox, Crabs, Crimean, Croup, Cryptococcosis, Cryptosporidiosis (Crypto), Cutaneous Larval Migrans, Cyclosporiasis, Cystic hydatid, Cysticercosis, Cystitis, Czechoslovak tick, D68 (EV-D68), Dacryocytitis, Dandy fever, Darling's Disease, Deer fly fever, Dengue fever (1, 2, 3 and 4), Desert rheumatism, Devil's grip, Diphasic milk fever, Diphtheria, Disseminated Intravascular Coagulation, Dog tapeworm, Donovanosis, Donovanosis (Granuloma *inguinale*), Dracontiasis, Dracunculosis, Duke's disease, Dum Dum Disease, Durand-Nicholas-Favre disease, Dwarf tapeworm, *E. Coli* infection (*E. coli*), Eastern equine encephalitis, Ebola Hemorrhagic Fever (Ebola virus disease EVD), Ectothrix, Ehrlichiosis (Sennetsu fever), Encephalitis, Endemic Relapsing fever, Endemic syphilis, Endophthalmitis, Endothrix, Enterobiasis (Pinworm infection), Enterotoxin-B Poisoning (Staph Food Poisoning), Enterovirus Infection, Epidemic Keratoconjunctivitis, Epidemic Relapsing fever, Epidemic typhus, Epiglottitis, Erysipelis, Erysipeloid (Erysipelothricosis), Erythema chronicum migrans, Erythema infectiosum, Erythema marginatum, Erythema multiforme, Erythema nodosum, Erythema nodosum leprosum, Erythrasma, Espundia, Eumycotic mycetoma, European blastomycosis, Exanthem subitum (Sixth disease), Eyeworm, Far Eastern tick, Fascioliasis, Fievre boutonneuse (Tick typhus), Fifth Disease (erythema infectiosum), Filatow-Dukes' Disease (Scalded Skin Syndrome; Ritter's Disease), Fish tapeworm, Fitz-Hugh-Curtis syndrome-Perihepatitis, Flinders Island Spotted Fever, Flu (Influenza), Folliculitis, Four Corners Disease, Four Corners Disease (Human Pulmonary Syndrome (HPS)), Frambesia, Francis disease, Furunculosis, Gas gangrene, Gastroenteritis, Genital Herpes, Genital Warts, German measles, Gerstmann-Straussler-Scheinker (GSS), Giardiasis, Gilchrist's disease, Gingivitis, Gingivostomatitis, Glanders, Glandular fever (infectious mononucleosis), Gnathostomiasis, Gonococcal Infection (Gonorrhea), Gonorrhea, Granuloma inguinale (Donovanosis), Guinea Worm, Haemophilus Influenza disease, Hamburger disease, Hansen's disease-leprosy, Hantaan disease, Hantaan-Korean hemorrhagic fever, Hantavirus Pulmonary Syndrome, Hantavirus Pulmonary Syndrome (HPS), Hard chancre, Hard measles, Haverhill fever-Rat bite fever, Head and Body Lice, Heartland fever, Helicobacterosis, Hemolytic Uremic Syndrome (HUS), Hepatitis A, Hepatitis B, Hepatitis C, Hepatitis D, Hepatitis E, Herpangina, Herpes-genital, Herpes labialis, Herpes-neonatal, Hidradenitis, Histoplasmosis, Histoplasmosis infection (Histoplasmosis), His-Werner disease, HIV infection, Hookworm infections, Hordeola, Hordeola (Stye), HTLV, HTLV-associated myelopathy (HAM), Human granulocytic ehrlichiosis, Human monocytic ehrlichiosis, Human Papillomavirus (HPV), Human Pulmonary Syndrome, Hydatid cyst, Hydrophobia, Impetigo, Including congenital (German Measles), Inclusion conjunctivitis, Inclusion conjunctivitis—Swimming Pool conjunctivitis-Pannus, Infantile diarrhea, Infectious Mononucleosis, Infectious myocarditis, Infectious pericarditis, Influenza, Isosporiasis, Israeli spotted fever, Japanese Encephalitis, Jock itch, Jorge Lobo disease—lobomycosis, Jungle yellow fever, Junin Argentinian hemorrhagic fever, Kala Azar, Kaposi's sarcoma, Keloidal blastomycosis, Keratoconjunctivitis, Kuru, Kyasanur forest disease, LaCrosse encephalitis, Lassa hemorrhagic fever, Legionellosis (Legionnaires Disease), Legionnaire's pneumonia, Lemierre's Syndrome (Postanginal septicemia), Lemming fever, Leprosy, Leptospirosis (Nanukayami fever; Weil's disease), Listeriosis (Listeria), Liver fluke infection, Lobo's mycosis, Lockjaw, Loiasis, Louping Ill, Ludwig's angina, Lung fluke infection, Lung fluke infection (Paragonimiasis), Lyme disease, Lymphogranuloma venereum infection (LGV), Machupo Bolivian hemorrhagic fever, Madura foot, Mal del pinto, Malaria, Malignant pustule, Malta fever, Marburg hemorrhagic fever, Masters disease, Maternal Sepsis (Puerperal fever), Measles, Mediterranean spotted fever, Melioidosis (Whitmore's disease), Meningitis, Meningococcal Disease, MERS, Milker's nodule, Molluscum contagiosum, Moniliasis, monkeypox, Mononucleosis, Mononucleosis-like syndrome, Montezuma's Revenge, Morbilli, MRSA (methicillin-resistant *Staphylococcus aureus*) infection, Mucormycosis-Zygomycosis, Multiple Organ Dysfunction Syndrome or MODS, Multiple-system atrophy (MSA), Mumps, Murine typhus, Murray Valley Encephalitis (MVE), Mycoburuli ulcers, Mycoburuli ulcers-Buruli ulcers, Mycotic vulvovaginitis, Myositis, Nanukayami fever, Necrotizing fasciitis, Necrotizing fasciitis-Type 1, Necrotizing fasciitis-Type 2, Negishi, New world spotted fever, Nocardiosis, Nongonococcal urethritis, Non-Polio (Non-Polio Enterovirus), Norovirus infection, North American blastomycosis, North Asian tick typhus, Norwalk virus infection, Norwegian itch, O'Hara disease, Omsk hemorrhagic fever, Onchoceriasis, Onychomycosis, Opisthorchiasis, Opthalmia neonatorium, Oral hairy leukoplakia, Orf, Oriental Sore, Oriental Spotted Fever, Omithosis (Parrot fever; Psittacosis), Oroya fever, Otitis externa, Otitis media, Pannus, Paracoccidioidomycosis, Paragonimiasis, Paralytic Shellfish Poisoning (Paralytic Shellfish Poisoning), Paronychia (Whitlow), Parotitis, PCP pneumonia, Pediculosis, Peliosis hepatica, Pelvic Inflammatory Disease, Pertussis (also called Whooping cough), Phaeohyphomycosis, Pharyngoconjunctival fever, Piedra (White Piedra), Piedra (Black Piedra), Pigbel, Pink eye conjunctivitis, Pinta, Pinworm infection, Pitted Keratolysis, Pityriasis versicolor (*Tinea versicolor*), Plague; Bubonic, Pleurodynia, Pneumococcal Disease, Pneumocystosis, Pneumonia, Pneumonic (Plague), Polio or Poliomyelitis, Polycystic hydatid, Pontiac fever, Pork tapeworm, Posada-Wernicke disease, Postanginal septicemia, Powassan, Progressive multifocal leukoencephalopathy, Progressive Rubella Panencephalitis, Prostatitis, Pseudomembranous colitis, Psittacosis, Puerperal fever, Pustular Rash diseases (Small pox), Pyelonephritis, Pylephlebitis, Q-Fever, Quinsy, Quintana fever (5-day fever), Rabbit fever, Rabies, Racoon roundworm infection, Rat bite fever, Rat tapeworm, Reiter Syndrome, Relapsing fever, Respiratory syncytial virus (RSV) infection, Rheumatic fever, Rhodotorulosis, Ricin Poisoning, Rickettsialpox, Rickettsiosis, Rift Valley Fever, Ringworm, Ritter's Disease, River Blindness, Rocky Mountain spotted fever, Rose Handler's disease (Sporotrichosis), Rose rash of infants, Roseola, Ross River fever, Rotavirus infection, Roundworm infections, Rubella, Rubeola, Russian spring, Salmonellosis gastroenteritis, San Joaquin Valley fever, Sao Paulo Encephalitis, Sao Paulo fever, SARS, Scabies Infestation (Scabies) (Norwegian itch), Scalded Skin Syndrome, Scarlet fever (Scarlatina), Schistosomiasis, Scombroid, Scrub typhus, Sennetsu fever, Sepsis (Septic shock), Severe Acute Respiratory Syndrome, Severe Acute Respiratory Syndrome (SARS), Shiga Toxigenic Escherichia coli (STEC/VTEC), Shigellosis gastroenteritis (Shigella), Shinbone fever, Shingles, Shipping fever, Siberian tick typhus, Sinusitis, Sixth disease, Slapped cheek disease, Sleeping sickness, Smallpox (Variola), Snail Fever, Soft chancre, Southern tick associated rash illness, Sparganosis, Spelunker's disease, Sporadic typhus, Sporotrichosis, Spotted fever, Spring, St. Louis encephalitis, Staphylococcal Food Poisoning, Staphylococcal Infection, Strep. throat, Streptococcal Disease, Streptococcal Toxic-Shock Syndrome, Strongyloiciasis, Stye, Subacute Sclerosing Panencephalitis, Subacute Sclerosing Panencephalitis (SSPE), Sudden Acute Respiratory Syndrome, Sudden Rash, Swimmer's ear, Swimmer's Itch, Swimming Pool conjunctivitis, Sylvatic yellow fever, Syphilis, Systemic Inflammatory Response Syndrome (SIRS), Tabes dorsalis (tertiary syphilis), Taeniasis, Taiga encephalitis, Tanner's disease, Tapeworm infections, Temporal lobe encephalitis, Temporal lobe encephalitis, tetani (Lock Jaw), Tetanus Infection, Threadworm infections, Thrush, Tick, Tick typhus, *Tinea barbae, Tinea capitis, Tinea corporis, Tinea cruris, Tinea manuum, Tinea nigra, Tinea pedis, Tinea unguium, Tinea versicolor*, Torulopsosis, Torulosis, Toxic Shock Syndrome, Toxoplasmosis, transmissible spongioform (CJD), Traveler's diarrhea, Trench fever 5, Trichinellosis, Trichomoniasis, Trichomycosis axillaris, Trichuriasis, Tropical Spastic Paraparesis (TSP), Trypanosomiasis, Tuberculosis (TB), Tuberculosis, Tularemia, Typhoid Fever, Typhus fever, Ulcus molle, Undulant fever, Urban yellow fever, Urethritis, Vaginitis, Vaginosis, Vancomycin Intermediate (VISA), Vancomycin Resistant (VRSA), Varicella, Venezuelan Equine encephalitis, *Verruga peruana, Vibrio cholerae* (Cholera), Vibriosis (*Vibrio*), Vincent's disease or Trench mouth, Viral conjunctivitis, Viral Meningitis, Viral meningoencephalitis, Viral rash, Visceral Larval Migrans, Vomito negro, Vulvovaginitis, Warts, Waterhouse, Weil's disease, West Nile Fever, Western equine encephalitis, Whipple's disease, Whipworm infection, White Piedra, Whitlow, Whitmore's disease, Winter diarrhea, Wolhynia fever, Wool sorters' disease, Yaws, Yellow Fever, Yersinosis, Yersinosis (*Yersinia*), Zahorsky's disease, Zika virus disease, Zoster, Zygomycosis, John Cunningham Virus (JCV), Human immunodeficiency virus (HIV), Influenza virus, Hepatitis B, Hepatitis C, Hepatitis D, Respiratory syncytial virus (RSV), Herpes simplex virus 1 and 2, Human Cytomegalovirus, Epstein-Barr virus, Varicella zoster virus, Coronaviruses, Poxviruses, Enterovirus 71, Rubella virus, Human papilloma virus, *Streptococcus pneumoniae, Streptococcus viridans, Staphylococcus aureus* (*S. aureus*), Methicillin-resistant *Staphylococcus aureus* (MRSA), Vancomycin-intermediate *Staphylococcus aureus* (VISA), Vancomycin-resistant *Staphylococcus aureus* (VRSA), *Staphylococcus epidermidis* (*S. epidermidis*), *Clostridium Tetani, Bordetella pertussis, Bordetella paratussis, Mycobacterium, Francisella tularensis, Toxoplasma gondii, Candida* (*C. albicans, C. glabrata, C. parapsilosis, C. tropicalis, C. krusei* and *C. lusitaniae*) and/or any other infectious diseases, disorders or syndromes.

Various toxins may be treated with pharmaceutical compositions, biocircuits, biocircuit components, effector modules including their SREs or payloads of the present invention. Non-limited examples of toxins include Ricin, *Bacillus anthracis*, Shiga toxin and Shiga-like toxin, Botulinum toxins.

Various tropical diseases may be treated with pharmaceutical compositions, biocircuits, biocircuit components, effector modules including their SREs or payloads of the present invention. Non-limited examples of tropical diseases include Chikungunya fever, Dengue fever, Chagas disease, Rabies, Malaria, Ebola virus, Marburg virus, West Nile Virus, Yellow Fever, Japanese encephalitis virus, St. Louis encephalitis virus.

Various foodborne illnesses and gastroenteritis may be treated with pharmaceutical compositions, biocircuits, biocircuit components, effector modules including their SREs or payloads of the present invention. Non-limited examples of foodborne illnesses and gastroenteritis include Rotavirus, Norwalk virus (Norovirus), *Campylobacter jejuni, Clostridium difficile, Entamoeba histolytica, Helicobacter pylori*, Enterotoxin B of *Staphylococcus aureus*, Hepatitis A virus (HAV), Hepatitis E, *Listeria monocytogenes*, Salmonella, *Clostridium perfringens*, and *Salmonella*.

Various infectious agents may be treated with pharmaceutical compositions, biocircuits, biocircuit components, effector modules including their SREs or payloads of the present invention. Non-limited examples of infectious agents include adenoviruses, *Anaplasma phagocytophilium, Ascaris lumbricoides, Bacillus anthracis, Bacillus cereus, Bacteroides* sp, Barmah Forest virus, *Bartonella bacilliformis, Bartonella henselae, Bartonella quintana*, beta-toxin of *Clostridium perfringens, Bordetella pertussis, Bordetella parapertussis, Borrelia burgdorferi, Borrelia miyamotoi, Borrelia recurrentis, Borrelia* sp., Botulinum toxin, *Brucella* sp., *Burkholderia pseudomallei*, California encephalitis virus, *Campylobacter, Candida albicans*, chikungunya virus, *Chlamydia psittaci, Chlamydia trachomatis, Clonorchis sinensis, Clostridium difficile* bacteria, *Clostridium tetani*, Colorado tick fever virus, *Corynebacterium diphtheriae, Corynebacterium minutissimum, Coxiella burnetii*, coxsackie A, coxsackie B, Crimean-Congo hemorrhagic fever virus, cytomegalovirus, dengue virus, Eastern Equine encephalitis virus, Ebola viruses, echovirus, *Ehrlichia chaffeensis, Ehrlichia equi, Ehrlichia* sp., *Entamoeba histolytica, Enterobacter* sp., *Enterococcus faecalis*, Enterovirus 71, Epstein-Barr virus (EBV), *Erysipelothrix rhusiopathiae, Escherichia coli*, Flavivirus, *Fusobacterium necrophorum, Gardnerella vaginalis*, Group B streptococcus, *Haemophilus aegyptius, Haemophilus ducreyi, Haemophilus influenzae*, hantavirus, *Helicobacter pylori*, Hepatitis A, Hepatitis B, Hepatitis C, Hepatitis D, Hepatitis E, herpes simplex virus 1 and 2, human herpes virus 6, human herpes Virus 8, human immunodeficiency virus 1 and 2, human T-cell leukemia viruses I and II, influenza viruses (A, B, C), Jamestown Canyon virus, Japanese encephalitis antigenic, Japanese encephalitis virus, John Cunninham virus, juninvirus, Kaposi's Sarcoma-associated Herpes Virus (KSHV), *Klebsiella granulomatis, Klebsiella* sp., Kyasanur Forest Disease virus, La Crosse virus, Lassavirus, *Legionella pneumophila, Leptospira interrogans, Listeria monocytogenes*, lymphocytic choriomeningitis virus, lyssavirus, Machupovirus, Marburg virus, measles virus, MERS coronavirus (MERS-CoV), *Micrococcus sedentarius, Mobiluncus* sp., Molluscipoxvirus, *Moraxella catarrhalis*, Morbilli-Rubeola virus, Mumps virus, *Mycobacterium leprae, Mycobacterium tuberculosis, Mycobacterium ulcerans, Mycoplasma genitalium, Mycoplasma* sp, Nairovirus, *Neisseria gonorrhoeae, Neisseria meningitidis*, Nocardia, Norwalk virus, norovirus, Omsk hemorrhagic fever virus, papilloma virus, parainfluenza viruses 1-3, parapoxvirus, parvovirus B19, *Peptostreptococccus* sp., *Plasmodium* sp., polioviruses types I, II, and III, *Proteus* sp., *Pseudomonas aeruginosa, Pseudomonas pseudomallei, Pseudomonas* sp., rabies virus, respiratory syncytial virus, ricin toxin, *Rickettsia australis, Rickettsia conori, Rickettsia honei, Rickettsia prowazekii*, Ross River Virus, rotavirus, rubellavirus, Saint Louis encephalitis, *Salmonella typhi, Sarcoptes scabiei*, SARS-associated coronavirus (SARS-CoV), *Serratia* sp., Shiga toxin and Shiga-like toxin, *Shigella* sp., Sin Nombre Virus, Snowshoe hare virus, *Staphylococcus aureus, Staphylococcus epidermidis, Streptobacillus moniliformis, Streptococcus pneumoniae, Streptococcus agalactiae, Streptococcus agalactiae, Streptococcus* group A-H, *Streptococcus pneumoniae, Streptococcus pyogenes, Treponemapallidum* subsp. *Pallidum, Treponema pallidum* var. *carateum, Treponema pallidum* var. *endemicum, Tropheryma whippelii, Ureaplasma urealyticum*, Varicella-Zoster virus, variola virus, *Vibrio cholerae*, West Nile virus, yellow fever virus, *Yersinia enterocolitica, Yersinia pestis*, and Zika virus.

Various rare diseases may be treated with pharmaceutical compositions, biocircuits, biocircuit components, effector modules including their SREs or payloads of the present invention. As used herein, the term "rare disease" refers to any disease that affects a small percentage of the population. As a non-limiting example, the rare disease may be Acrocephalosyndactylia, Acrodermatitis, Addison Disease, Adie Syndrome, Alagille Syndrome, Amylose, Amyotrophic Lateral Sclerosis, Angelman Syndrome, Angiolymphoid Hyperplasia with Eosinophilia, Arnold-Chiari Malformation, Arthritis, Juvenile Rheumatoid, Asperger Syndrome, Bardet-Biedl Syndrome, Barrett Esophagus, Beckwith-Wiedemann Syndrome, Behcet Syndrome, Bloom Syndrome, Bowen's Disease, Brachial Plexus Neuropathies, Brown-Sequard Syndrome, Budd-Chiari Syndrome, Burkitt Lymphoma, Carcinoma 256, Walker, Caroli Disease, Charcot-Marie-Tooth Disease, Chediak-Higashi Syndrome, Chiari-Frommel Syndrome, Chondrodysplasia Punctata, Colonic Pseudo-Obstruction, Colorectal Neoplasms, Hereditary Nonpolyposis, Craniofacial Dysostosis, Creutzfeldt-Jakob Syndrome, Crohn Disease, Cushing Syndrome, Cystic Fibrosis, Dandy-Walker Syndrome, De Lange Syndrome, Dementia, Vascular, Dermatitis Herpetiformis, DiGeorge Syndrome, Diffuse Cerebral Sclerosis of Schilder, Duane Retraction Syndrome, Dupuytren Contracture, Ebstein Anomaly, Eisenmenger Complex, Ellis-Van Creveld Syndrome, Encephalitis, Enchondromatosis, Epidermal Necrolysis, Toxic, Facial Hemiatrophy, Factor XII Deficiency, Fanconi Anemia, Felty's Syndrome, Fibrous Dysplasia, Polyostotic, Fox-Fordyce Disease, Friedreich Ataxia, Fusobacterium, Gardner Syndrome, Gaucher Disease, Gerstmann Syndrome, Giant Lymph Node Hyperplasia, Glycogen Storage Disease Type I, Glycogen Storage Disease Type II, Glycogen Storage Disease Type IV, Glycogen Storage Disease Type V, Glycogen Storage Disease Type VII, Goldenhar Syndrome, Guillain-Barre Syndrome, Hallermann's Syndrome, Hamartoma Syndrome, Multiple, Hartnup Disease, Hepatolenticular Degeneration, Hepatolenticular Degeneration, Hereditary Sensory and Motor Neuropathy, Hirschsprung Disease, Histiocytic Necrotizing Lymphadenitis, Histiocytosis, Langerhans-Cell, Hodgkin Disease, Homer Syndrome, Huntington Disease, Hyperaldosteronism, Hyperhidrosis, Hyperostosis, Diffuse Idiopathic Skeletal, Hypopituitarism, Inappropriate ADH Syndrome, Intestinal Polyps, Isaacs Syndrome, Kartagener Syndrome, Kearns-Sayre Syndrome, Klippel-Feil Syndrome, Klippel-Trenaunay-Weber Syndrome, Kluver-Bucy Syndrome, Korsakoff Syndrome, Lafora Disease, Lambert-Eaton Myasthenic Syndrome, Landau-Kleffner Syndrome, Langer-Giedion Syndrome, Leigh Disease, Lesch-Nyhan Syndrome, Leukodystrophy, Globoid Cell, Li-Fraumeni Syndrome, Long QT Syndrome, Machado-Joseph Disease, Mallory-Weiss Syndrome, Marek Disease, Marfan Syndrome, Meckel Diverticulum, Meige Syndrome, Melkersson-Rosenthal Syndrome, Meniere Disease, Mikulicz's Disease, Miller Fisher Syndrome, Mobius Syndrome, Moyamoya Disease, Mucocutaneous Lymph Node Syndrome, Mucopolysaccharidosis I, Mucopolysaccharidosis II, Mucopolysaccharidosis III, Mucopolysaccharidosis IV, Mucopolysaccharidosis VI, Multiple Endocrine Neoplasia Type 1, Munchausen Syndrome by Proxy, Muscular Atrophy, Spinal, Narcolepsy, Neuroaxonal Dystrophies, Neuromyelitis Optica, Neuronal Ceroid-Lipofuscinoses, Niemann-Pick Diseases, Noonan Syndrome, Optic Atrophies, Hereditary, Osteitis Deformans, Osteochondritis, Osteochondrodysplasias, Osteolysis, Essential, Paget Disease Extramammary, Paget's Disease, Mammary, Panniculitis, Nodular Nonsuppurative, Papillon-Lefevre Disease, Paralysis, Pelizaeus-Merzbacher Disease, Pemphigus, Benign Familial, Penile Induration, Pericarditis, Constrictive, Peroxisomal Disorders, Peutz-Jeghers Syndrome, Pick Disease of the Brain, Pierre Robin Syndrome, Pigmentation Disorders, Pityriasis Lichenoides, Polycystic Ovary Syndrome, Polyendocrinopathies, Autoimmune, Prader-Willi Syndrome, Pupil Disorders, Rett Syndrome, Reye Syndrome, Rubinstein-Taybi Syndrome, Sandhoff Disease, Sarcoma, Ewing's, Schnitzler Syndrome, Sjogren's Syndrome, Sjogren-Larsson Syndrome, Smith-Lemli-Opitz Syndrome, Spinal Muscular Atrophies of Childhood, Sturge-Weber Syndrome, Sweating, Gustatory, Takayasu Arteritis, Tangier Disease, Tay-Sachs Disease, Thromboangiitis Obliterans, Thyroiditis, Autoimmune, Tietze's Syndrome, Togaviridae Infections, Tolosa-Hunt Syndrome, Tourette Syndrome, Uveomeningoencephalitic Syndrome, Waardenburg's Syndrome, Wegener Granulomatosis, Weil Disease, Werner Syndrome, Williams Syndrome, Wilms Tumor, Wolff-Parkinson-White Syndrome, Wolfram Syndrome, Wolman Disease, Zellweger Syndrome, Zollinger-Ellison Syndrome, and von Willebrand Diseases.

Various autoimmune diseases and autoimmune-related diseases may be treated with pharmaceutical compositions, biocircuits, biocircuit components, effector modules including their SREs or payloads of the present invention. As used herein, the term "autoimmune disease" refers to a disease in which the body produces antibodies that attack its own tissues. As a non-limiting example, the autoimmune disease may be Acute Disseminated Encephalomyelitis (ADEM), Acute necrotizing hemorrhagic leukoencephalitis, Addison's disease, Agammaglobulinemia, Alopecia areata, Amyloidosis, Ankylosing spondylitis, Anti-GBM/Anti-TBM nephritis, Antiphospholipid syndrome (APS), Autoimmune angioedema, Autoimmune aplastic anemia, Autoimmune dysautonomia, Autoimmune hepatitis, Autoimmune hyperlipidemia, Autoimmune immunodeficiency, Autoimmune inner ear disease (AIED), Autoimmune myocarditis, Autoimmune oophoritis, Autoimmune pancreatitis, Autoimmune retinopathy, Autoimmune thrombocytopenic purpura (ATP), Autoimmune thyroid disease, Autoimmune urticaria, Axonal & neuronal neuropathies, Balo disease, Behcet's disease, Bullous pemphigoid, Cardiomyopathy, Castleman disease, Celiac disease, Chagas disease, Chronic fatigue syndrome, Chronic inflammatory demyelinating polyneuropathy (CIDP), Chronic recurrent multifocal ostomyelitis (CRMO), Churg-Strauss syndrome, Cicatricial pemphigoid/benign mucosal pemphigoid, Crohn's disease, Cogans syndrome, Cold agglutinin disease, Congenital heart block, Coxsackie myocarditis, CREST disease, Essential mixed cryoglobulinemia, Demyelinating neuropathies, Dermatitis herpetiformis, Dermatomyositis, Devic's disease (neuromyelitis optica), Discoid lupus, Dressler's syndrome, Endometriosis, Eosinophilic esophagitis, Eosinophilic fasciitis, Erythema nodosum, Experimental allergic encephalomyelitis, Evans syndrome, Fibromyalgia**, Fibrosing alveolitis, Giant cell arteritis (temporal arteritis), Giant cell myocarditis, Glomerulonephritis, Goodpasture's syndrome, Granulomatosis with Polyangiitis (GPA) (formerly called Wegener's Granulomatosis), Graves' disease, Guillain-Barre syndrome, Hashimoto's encephalitis, Hashimoto's thyroiditis, Hemolytic anemia, Henoch-Schonlein purpura, Herpes gestationis, Hypogammaglobulinemia, Idiopathic thrombocytopenic purpura (ITP), IgA nephropathy, IgG4-related sclerosing disease, Immunoregulatory lipoproteins, Inclusion body myositis, Interstitial cystitis, Juvenile arthritis, Juvenile diabetes (Type 1 diabetes), Juvenile myositis, Kawasaki syndrome, Lambert-Eaton syndrome, Leukocytoclastic vasculitis, Lichen planus, Lichen sclerosis, Ligneous conjunctivitis, Linear IgA disease (LAD), Lupus (SLE), Lyme disease, chronic, Meniere's disease, Microscopic polyangiitis, Mixed connective tissue disease (MCTD), Mooren's ulcer, Mucha-Habermann disease, Multiple sclerosis, Myasthenia gravis, Myositis, Narcolepsy, Neuromyelitis optica (Devic's), Neutropenia, Ocular cicatricial pemphigoid, Optic neuritis, Palindromic rheumatism, PANDAS (Pediatric Autoimmune Neuropsychiatric Disorders Associated with Streptococcus), Paraneoplastic cerebellar degeneration, Paroxysmal nocturnal hemoglobinuria (PNH), Parry Romberg syndrome, Parsonnage-Turner syndrome, Pars planitis (peripheral uveitis), Pemphigus, Peripheral neuropathy, Perivenous encephalomyelitis, Pernicious anemia, POEMS syndrome, Polyarteritis nodosa, Type I, II, & III autoimmune polyglandular syndromes, Polymyalgia rheumatica, Polymyositis, Postmyocardial infarction syndrome, Postpericardiotomy syndrome, Progesterone dermatitis, Primary biliary cirrhosis, Primary sclerosing cholangitis, Psoriasis, Psoriatic arthritis, Idiopathic pulmonary fibrosis, Pyoderma gangrenosum, Pure red cell aplasia, Raynauds phenomenon, Reactive Arthritis, Reflex sympathetic dystrophy, Reiter's syndrome, Relapsing polychondritis, Restless legs syndrome, Retroperitoneal fibrosis, Rheumatic fever, Rheumatoid arthritis, Sarcoidosis, Schmidt syndrome, Scleritis, Scleroderma, Sjogren's syndrome, Sperm & testicular autoimmunity, Stiff person syndrome, Subacute bacterial endocarditis (SBE), Susac's syndrome, Sympathetic ophthalmia, Takayasu's arteritis, Temporal arteritis/Giant cell arteritis, Thrombocytopenic purpura (TTP), Tolosa-Hunt syndrome, Transverse myelitis, Ulcerative colitis, Undifferentiated connective tissue disease (UCTD), Uveitis, Vasculitis, Vesiculobullous dermatosis, Vitiligo, and Wegener's granulomatosis (now termed Granulomatosis with Polyangiitis (GPA).

Various kidney diseases may be treated with pharmaceutical compositions, biocircuits, biocircuit components, effector modules including their SREs or payloads of the present invention. As a non-limiting example, the kidney disease Abderhalden-Kaufmann-Lignac syndrome (Nephropathic Cystinosis), Abdominal Compartment Syndrome, Acute Kidney Failure/Acute Kidney Injury, Acute Lobar Nephronia, Acute Phosphate Nephropathy, Acute Tubular Necrosis, Adenine Phosphoribosyltransferase Deficiency, Adenovirus Nephritis, Alport Syndrome, Amyloidosis, ANCA Vasculitis Related to Endocarditis and Other Infections, Angiomyolipoma, Analgesic Nephropathy, Anorexia Nervosa and Kidney Disease, Angiotensin Antibodies and Focal Segmental Glomerulosclerosis, Antiphospholipid Syndrome, Anti-TNF-α Therapy-related Glomerulonephritis, APOL1 Mutations, Apparent Mineralocorticoid Excess Syndrome, Aristolochic Acid Nephropathy, Chinese Herbal Nephropathy, Balkan Endemic Nephropathy, Bartter Syndrome, Beeturia, β-Thalassemia Renal Disease, Bile Cast Nephropathy, BK Polyoma Virus Nephropathy in the Native Kidney, Bladder Rupture, Bladder Sphincter Dyssynergia, Bladder Tamponade, Border-Crossers' Nephropathy, Bourbon Virus and Acute Kidney Injury, Burnt Sugarcane Harvesting and Acute Renal Dysfunction, Byetta and Renal Failure, C1q Nephropathy, Cannabinoid Hyperemesis Acute Renal Failure, Cardiorenal syndrome, Carfilzomib-Indiced Renal Injury, CFHR5 nephropathy, Charcot-Marie-Tooth Disease with Glomerulopathy, Cherry Concentrate and Acute Kidney Injury, Cholesterol Emboli, Churg-Strauss syndrome, Chyluria, Colistin Nephrotoxicity, Collagenofibrotic Glomerulopathy, Collapsing Glomerulopathy, Collapsing Glomerulopathy Related to CMV, Congenital Nephrotic Syndrome, Conorenal syndrome (Mainzer-Saldino Syndrome or Saldino-Mainzer Disease), Contrast Nephropathy, Copper Sulfate Intoxication, Cortical Necrosis, Crizotinib-related Acute Kidney Injury, Cryoglobuinemia, Crystalglobulin-Induced Nephropathy, Crystal-Induced Acute Kidney injury, Cystic Kidney Disease, Acquired, Cystinuria, Dasatinib-Induced Nephrotic-Range Proteinuria, Dense Deposit Disease (MPGN Type 2), Dent Disease (X-linked Recessive Nephrolithiasis), Dialysis Disequilibrium Syndrome, Diabetes and Diabetic Kidney Disease, Diabetes Insipidus, Dietary Supplements and Renal Failure, Drugs of Abuse and Kidney Disease, Duplicated Ureter, EAST syndrome, Ebola and the Kidney, Ectopic Kidney, Ectopic Ureter, Edema, Swelling, Erdheim-Chester Disease, Fabry's Disease, Familial Hypocalciuric Hypercalcemia, Fanconi Syndrome, Fraser syndrome, Fibronectin Glomerulopathy, Fibrillary Glomerulonephritis and Immunotactoid Glomerulopathy, Fraley syndrome, Focal Segmental Glomerulosclerosis, Focal Sclerosis, Focal Glomerulosclerosis, Galloway Mowat syndrome, Giant Cell (Temporal) Arteritis with Kidney Involvement, Gestational Hypertension, Gitelman Syndrome, Glomerular Diseases, Glomerular Tubular Reflux, Glycosuria, Goodpasture Syndrome, Hair Dye Ingestion and Acute Kidney Injury, Hantavirus Infection Podocytopathy, Hematuria (Blood in Urine), Hemolytic Uremic Syndrome (HUS), Atypical Hemolytic Uremic Syndrome (aHUS), Hemophagocytic Syndrome, Hemorrhagic Cystitis, Hemorrhagic Fever with Renal Syndrome (HFRS, Hantavirus Renal Disease, Korean Hemorrhagic Fever, Epidemic Hemorrhagic Fever, Nephropathis Epidemica), Hemosiderosis related to Paroxysmal Nocturnal Hemoglobinuria and Hemolytic Anemia, Hepatic Glomerulopathy, Hepatic Veno-Occlusive Disease, Sinusoidal Obstruction Syndrome, Hepatitis C-Associated Renal Disease, Hepatorenal Syndrome, Herbal Supplements and Kidney Disease, High Blood Pressure and Kidney Disease, HIV-Associated Nephropathy (HIVAN), Horseshoe Kidney (Renal Fusion), Hunner's Ulcer, Hyperaldosteronism, Hypercalcemia, Hyperkalemia, Hypermagnesemia, Hypernatremia, Hyperoxaluria, Hyperphosphatemia, Hypocalcemia, Hypokalemia, Hypokalemia-induced renal dysfunction, Hypokalemic Periodic Paralysis, Hypomagnesemia, Hyponatremia, Hypophosphatemia, IgA Nephropathy, IgG4 Nephropathy, Interstitial Cystitis, Painful Bladder Syndrome (Questionnaire), Interstitial Nephritis, Ivemark's syndrome, Ketamine-Associated Bladder Dysfunction, Kidney Stones, Nephrolithiasis, Kombucha Tea Toxicity, Lead Nephropathy and Lead-Related Nephrotoxicity, Leptospirosis Renal Disease, Light Chain Deposition Disease, Monoclonal Immunoglobulin Deposition Disease, Liddle Syndrome, Lightwood-Albright Syndrome, Lipoprotein Glomerulopathy, Lithium Nephrotoxicity, LMX1B Mutations Cause Hereditary FSGS, Loin Pain Hematuria, Lupus, Systemic Lupus Erythematosis, Lupus Kidney Disease, Lupus Nephritis, Lupus Nephritis with Antineutrophil Cytoplasmic Antibody Seropositivity, Lyme Disease-Associated Glomerulonephritis, Malarial Nephropathy, Malignancy-Associated Renal Disease, Malignant Hypertension, Malakoplakia, Meatal Stenosis, Medullary Cystic Kidney Disease, Medullary Sponge Kidney, Megaureter, Melamine Toxicity and the Kidney, Membranoproliferative Glomerulonephritis, Membranous Nephropathy, MesoAmerican Nephropathy, Metabolic Acidosis, Metabolic Alkalosis, Methotrexate-related Renal Failure, Microscopic Polyangiitis, Milk-alkalai syndrome, Minimal Change Disease, MDMA (Molly; Ecstacy; 3,4-Methylenedioxymethamphetamine) and Kidney Failure, Multicystic dysplastic kidney, Multiple Myeloma, Myeloproliferative Neoplasms and Glomerulopathy, Nail-patella Syndrome, Nephrocalcinosis, Nephrogenic Systemic Fibrosis, Nephroptosis (Floating Kidney, Renal Ptosis), Nephrotic Syndrome, Neurogenic Bladder, Nodular Glomerulosclerosis, Non-Gonococcal Urethritis, Nutcracker syndrome, Orofaciodigital Syndrome, Orotic Aciduria, Orthostatic Hypotension, Orthostatic Proteinuria, Osmotic Diuresis, Ovarian Hyperstimulation Syndrome, Page Kidney, Papillary Necrosis, Papillorenal Syndrome (Renal-Coloboma Syndrome, Isolated Renal Hypoplasia), Parvovirus B19 and the Kidney, The Peritoneal-Renal Syndrome, Posterior Urethral Valve, Post-infectious Glomerulonephritis, Post-streptococcal Glomerulonephritis, Polyarteritis Nodosa, Polycystic Kidney Disease, Posterior Urethral Valves, Preeclampsia, Propofol infusion syndrome, Proliferative Glomerulonephritis with Monoclonal IgG Deposits (Nasr Disease), Propolis (Honeybee Resin) Related Renal Failure, Proteinuria (Protein in Urine), Pseudohyperaldosteronism, Pseudohypobicarbonatemia, Pseudohypoparathyroidism, Pulmonary-Renal Syndrome, Pyelonephritis (Kidney Infection), Pyonephrosis, Radiation Nephropathy, Ranolazine and the Kidney, Refeeding syndrome, Reflux Nephropathy, Rapidly Progressive Glomerulonephritis, Renal Abscess, Perinephric Abscess, Renal Agenesis, Renal Arcuate Vein Microthrombi-Associated Acute Kidney Injury, Renal Artery Aneurysm, Renal Artery Stenosis, Renal Cell Cancer, Renal Cyst, Renal Hypouricemia with Exercise-induced Acute Renal Failure, Renal Infarction, Renal Osteodystrophy, Renal Tubular Acidosis, Renin Secreting Tumors (Juxtaglomerular Cell Tumor), Reset Osmostat, Retrocaval Ureter, Retroperitoneal Fibrosis, Rhabdomyolysis, Rhabdomyolysis related to Bariatric Surgery, Rheumatoid Arthritis-Associated Renal Disease, Sarcoidosis Renal Disease, Salt Wasting, Renal and Cerebral, Schistosomiasis and Glomerular Disease, Schimke immuno-osseous dysplasia, Scleroderma Renal Crisis, Serpentine Fibula-Polycystic Kidney Syndrome, Exner Syndrome, Sickle Cell Nephropathy, Silica Exposure and Chronic Kidney Disease, Sri Lankan Farmers' Kidney Disease, Sjögren's Syndrome and Renal Disease, Synthetic Cannabinoid Use and Acute Kidney Injury, Kidney Disease Following Hematopoietic Cell Transplantation, Kidney Disease Related to Stem Cell Transplantation, Thin Basement Membrane Disease, Benign Familial Hematuria, Trigonitis, Tuberculosis, Genitourinary, Tuberous Sclerosis, Tubular Dysgenesis, Immune Complex Tubulointerstitial Nephritis Due to Autoantibodies to the Proximal Tubule Brush Border, Tumor Lysis Syndrome, Uremia, Uremic Optic Neuropathy, Ureteritis Cystica, Ureterocele, Urethral Caruncle, Urethral Stricture, Urinary Incontinence, Urinary Tract Infection, Urinary Tract Obstruction, Vesicointestinal Fistula, Vesicoureteral Reflux, Volatile Anesthetics and Acute Kidney Injury, Von Hippel-Lindau Disease, Waldenstrom's Macroglobulinemic Glomerulonephritis, Warfarin-Related Nephropathy, Wasp Stings and Acute Kidney Injury, Wegener's Granulomatosis, Granulomatosis with Polyangiitis, West Nile Virus and Chronic Kidney Disease, and Wunderlich syndrome.

Various cardiovascular diseases may be treated with pharmaceutical compositions, biocircuits, biocircuit components, effector modules including their SREs or payloads of the present invention. As a non-limiting example, the cardiovascular disease may be Ischemic heart disease also known as coronary artery disease, Cerebrovascular disease (Stroke), Peripheral vascular disease, Heart failure, Rheumatic heart disease, and Congenital heart disease.

Various antibody deficiencies may be treated with pharmaceutical compositions, biocircuits, biocircuit components, effector modules including their SREs or payloads of the present invention. As a non-limiting example, the antibody deficiencies may be X-Linked Agammaglobulinemia (XLA), Autosomal Recessive Agammaglobulinemia (ARA), Common Variable Immune Deficiency (CVID), IgG (IgG1, IgG2, IgG3 and IgG4) Subclass Deficiency, Selective IgA Deficiency, Specific Antibody Deficiency (SAD), Transient Hypogammaglobulinemia of Infancy, Antibody Deficiency with Normal or Elevated Immunoglobulins, Selective IgM Deficiency, Immunodeficiency with Thymoma (Good's Syndrome), Transcobalamin II Deficiency, Warts, Hypogammaglobulinemia, Infection, Myelokathexis (WHIM) Syndrome, Drug-Induced Antibody Deficiency, Kappa Chain Deficiency, Heavy Chain Deficiencies, Post-Meiotic Segregation (PMS2) Disorder, and Unspecified Hypogammaglobulinemia.

Various ocular diseases may be treated with pharmaceutical compositions, biocircuits, biocircuit components, effector modules including their SREs or payloads of the present invention. As a non-limiting example, the ocular disease may be thyroid eye disease (TED), Graves' disease (GD) and orbitopathy, Retina Degeneration, Cataract, optic atrophy, macular degeneration, Leber congenital amaurosis, retinal degeneration, cone-rod dystrophy, Usher syndrome, leopard syndrome, photophobia, and photoaversion.

Various neurological diseases may be treated with pharmaceutical compositions, biocircuits, biocircuit components, effector modules including their SREs or payloads of the present invention. As a non-limiting example, the neurological disease may be Absence of the Septum Pellucidum, Acid Lipase Disease, Acid Maltase Deficiency, Acquired Epileptiform Aphasia, Acute Disseminated Encephalomyelitis, Attention Deficit-Hyperactivity Disorder (ADHD), Adie's Pupil, Adie's Syndrome, Adrenoleukodystrophy, Agenesis of the Corpus Callosum, Agnosia, Aicardi Syndrome, Aicardi-Goutieres Syndrome Disorder, AIDS—Neurological Complications, Alexander Disease, Alpers' Disease, Alternating Hemiplegia, Alzheimer's Disease, Amyotrophic Lateral Sclerosis (ALS), Anencephaly, Aneurysm, Angelman Syndrome, Angiomatosis, Anoxia, Antiphospholipid Syndrome, Aphasia, Apraxia, Arachnoid Cysts, Arachnoiditis, Arnold-Chiari Malformation, Arteriovenous Malformation, Asperger Syndrome, Ataxia, Ataxia Telangiectasia, Ataxias and Cerebellar or Spinocerebellar Degeneration, Atrial Fibrillation and Stroke, Attention Deficit-Hyperactivity Disorder, Autism Spectrum Disorder, Autonomic Dysfunction, Back Pain, Barth Syndrome, Batten Disease, Becker's Myotonia, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain and Spinal Tumors, Brain Aneurysm, Brain Injury, Brown-Sequard Syndrome, Bulbospinal Muscular Atrophy, Cerebral Autosomal Dominant Arteriopathy with Sub-cortical Infarcts and Leukoencephalopathy (CADASIL), Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Central Pontine Myelinolysis, Cephalic Disorders, Ceramidase Deficiency, Cerebellar Degeneration, Cerebellar Hypoplasia, Cerebral Aneurysms, Cerebral Arteriosclerosis, Cerebral Atrophy, Cerebral Beriberi, Cerebral Cavernous Malformation, Cerebral Gigantism, Cerebral Hypoxia, Cerebral Palsy, Cerebro-Oculo-Facio-Skeletal Syndrome (COFS), Charcot-Marie-Tooth Disease, Chiari Malformation, Cholesterol Ester Storage Disease, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Colpocephaly, Coma, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Cree encephalitis, Creutzfeldt-Jakob Disease, Cumulative Trauma Disorders, Cushing's Syndrome, Cytomegalic Inclusion Body Disease, Cytomegalovirus Infection, Dancing Eyes-Dancing Feet Syndrome, Dandy-Walker Syndrome, Dawson Disease, De Morsier's Syndrome, Dejerine-Klumpke Palsy, Dementia, Dementia-Multi-Infarct, Dementia—Semantic, Dementia-Subcortical, Dementia With Lewy Bodies, Dentate Cerebellar Ataxia, Dentatorubral Atrophy, Dermatomyositis, Developmental Dyspraxia, Devic's Syndrome, Diabetic Neuropathy, Diffuse Sclerosis, Dravet Syndrome, Dysautonomia, Dysgraphia, Dyslexia, Dysphagia, Dyspraxia, Dyssynergia Cerebellaris Myoclonica, Dyssynergia Cerebellaris Progressiva, Dystonias, Early Infantile Epileptic Encephalopathy, Empty Sella Syndrome, Encephalitis, Encephalitis Lethargica, Encephaloceles, Encephalopathy, Encephalopathy (familial infantile), Encephalotrigeminal Angiomatosis, Epilepsy, Epileptic Hemiplegia, Erb's Palsy, Erb-Duchenne and Dej erine-Klumpke Palsies, Essential Tremor, Extrapontine Myelinolysis, Fabry Disease, Fahr's Syndrome, Fainting, Familial Dysautonomia, Familial Hemangioma, Familial Idiopathic Basal Ganglia Calcification, Familial Periodic Paralyses, Familial Spastic Paralysis, Farber's Disease, Febrile Seizures, Fibromuscular Dysplasia, Fisher Syndrome, Floppy Infant Syndrome, Foot Drop, Friedreich's Ataxia, Frontotemporal Dementia, Gaucher Disease, Generalized Gangliosidoses, Gerstmann's Syndrome, Gerstmann-Straussler-Scheinker Disease, Giant Axonal Neuropathy, Giant Cell Arteritis, Giant Cell Inclusion Disease, Globoid Cell Leukodystrophy, Glossopharyngeal Neuralgia, Glycogen Storage Disease, Guillain-Barre Syndrome, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster, Herpes Zoster Oticus, Hirayama Syndrome, Holmes-Adie syndrome, Holoprosencephaly, HTLV-1 Associated Myelopathy, Hughes Syndrome, Huntington's Disease, Hydranencephaly, Hydrocephalus, Hydrocephalus—Normal Pressure, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Neuroaxonal Dystrophy, Infantile Phytanic Acid Storage Disease, Infantile Refsum Disease, Infantile Spasms, Inflammatory Myopathies, Iniencephaly, Intestinal Lipodystrophy, Intracranial Cysts, Intracranial Hypertension, Isaacs' Syndrome, Joubert Syndrome, Kearns-Sayre Syndrome, Kennedy's Disease, Kinsbourne syndrome, Kleine-Levin Syndrome, Klippel-Feil Syndrome, Klippel-Trenaunay Syndrome (KTS), Kliver-Bucy Syndrome, Korsakoff's Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lipid Storage Diseases, Lipoid Proteinosis, Lissencephaly, Locked-In Syndrome, Lou Gehrig's Disease, Lupus—Neurological Sequelae, Lyme Disease—Neurological Complications, Machado-Joseph Disease, Macrocephaly, Megalocephaly, Melkersson-Rosenthal Syndrome, Meningitis, Meningitis and Encephalitis, Menkes Disease, Meralgia Paresthetica, Metachromatic Leukodystrophy, Microcephaly, Migraine, Miller Fisher Syndrome, Mini Stroke, Mitochondrial Myopathy, Moebius Syndrome, Monomelic Amyotrophy, Motor Neuron Diseases, Moyamoya Disease, Mucolipidoses, Mucopolysaccharidosis, Multi-Infarct Dementia, Multifocal Motor Neuropathy, Multiple Sclerosis, Multiple System Atrophy, Multiple System Atrophy with Orthostatic Hypotension, Muscular Dystrophy, Myasthenia—Congenital, Myasthenia Gravis, Myelinoclastic Diffuse Sclerosis, Myoclonic Encephalopathy of Infants, Myoclonus, Myopathy, Myopathy—Congenital, Myopathy—Thyrotoxic, Myotonia, Myotonia Congenita, Narcolepsy, Neuroacanthocytosis, Neurodegeneration with Brain Iron Accumulation, Neurofibromatosis, Neuroleptic Malignant Syndrome, Neurological Complications of AIDS, Neurological Complications of Lyme Disease, Neurological Consequences of Cytomegalovirus Infection, Neurological Manifestations of Pompe Disease, Neurological Sequelae Of Lupus, Neuromyelitis Optica, Neuromyotonia, Neuronal Ceroid Lipofuscinosis, Neuronal Migration Disorders, Neuropathy-Hereditary, Neurosarcoidosis, Neurosyphilis, Neurotoxicity, Nevus Cavernosus, Niemann-Pick Disease, O'Sullivan-McLeod Syndrome, Occipital Neuralgia, Ohtahara Syndrome, Olivopontocerebellar Atrophy, Opsoclonus Myoclonus, Orthostatic Hypotension, Overuse Syndrome, Pain—Chronic, Pantothenate Kinase-Associated Neurodegeneration, Paraneoplastic Syndromes, Paresthesia, Parkinson's Disease, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Pinched Nerve, Piriformis Syndrome, Pituitary Tumors, Polymyositis, Pompe Disease, Porencephaly, Post-Polio Syndrome, Postherpetic Neuralgia, Post infectious Encephalomyelitis, Postural Hypotension, Postural Orthostatic Tachycardia Syndrome, Postural Tachycardia Syndrome, Primary Dentatum Atrophy, Primary Lateral Sclerosis, Primary Progressive Aphasia, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Prosopagnosia, Pseudo-Torch syndrome, Pseudotoxoplasmosis syndrome, Pseudotumor Cerebri, Psychogenic Movement, Ramsay Hunt Syndrome I, Ramsay Hunt Syndrome II, Rasmussen's Encephalitis, Reflex Sympathetic Dystrophy Syndrome, Refsum Disease, Refsum Disease—Infantile, Repetitive Motion Disorders, Repetitive Stress Injuries, Restless Legs Syndrome, Retrovirus-Associated Myelopathy, Rett Syndrome, Reye's Syndrome, Rheumatic Encephalitis, Riley-Day Syndrome, Sacral Nerve Root Cysts, Saint Vitus Dance, Salivary Gland Disease, Sandhoff Disease, Schilder's Disease, Schizencephaly, Seitelberger Disease, Seizure Disorder, Semantic Dementia, Septo-Optic Dysplasia, Severe Myoclonic Epilepsy of Infancy (SMEI), Shaken Baby Syndrome, Shingles, Shy-Drager Syndrome, Sjögren's Syndrome, Sleep Apnea, Sleeping Sickness, Sotos Syndrome, Spasticity, Spina Bifida, Spinal Cord Infarction, Spinal Cord Injury, Spinal Cord Tumors, Spinal Muscular Atrophy, Spinocerebellar Atrophy, Spinocerebellar Degeneration, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Short-lasting, Unilateral, Neuralgiform (SUNCT) Headache, Swallowing Disorders, Sydenham Chorea, Syncope, Syphilitic Spinal Sclerosis, Syringohydromyelia, Syringomyelia, Systemic Lupus Erythematosus, Tabes Dorsalis, Tardive Dyskinesia, Tarlov Cysts, Tay-Sachs Disease, Temporal Arteritis, Tethered Spinal Cord Syndrome, Thomsen's Myotonia, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Troyer Syndrome, Tuberous Sclerosis, Vascular Erectile Tumor, Vasculitis Syndromes of the Central and Peripheral Nervous Systems, Von Economo's Disease, Von Hippel-Lindau Disease (VHL), Von Recklinghausen's Disease, Wallenberg's Syndrome, Werdnig-Hoffman Disease, Wernicke-Korsakoff Syndrome, West Syndrome, Whiplash, Whipple's Disease, Williams Syndrome, Wilson Disease, Wolman's Disease, X-Linked Spinal and Bulbar Muscular Atrophy.

Various psychological disorders may be treated with pharmaceutical compositions, biocircuits, biocircuit components, effector modules including their SREs or payloads of the present invention. As a non-limiting example, the psychological disorders may be Aboulia, Absence epilepsy, Acute stress Disorder, Adjustment Disorders, Adverse effects of medication NOS, Age related cognitive decline, Agoraphobia, Alcohol Addiction, Alzheimer's Disease, Amnesia (also known as Amnestic Disorder), Amphetamine Addiction, Anorexia Nervosa, Anterograde amnesia, Antisocial personality disorder (also known as Sociopathy), Anxiety Disorder (Also known as Generalized Anxiety Disorder), Anxiolytic related disorders, Asperger's Syndrome (now part of Autism Spectrum Disorder), Attention Deficit Disorder (Also known as ADD), Attention Deficit Hyperactivity Disorder (Also known as ADHD), Autism Spectrum Disorder (also known as Autism), Autophagia, Avoidant Personality Disorder, Barbiturate related disorders, Benzodiazepine related disorders, Bereavement, Bibliomania, Binge Eating Disorder, Bipolar disorder (also known as Manic Depression, includes Bipolar I and Bipolar II), Body Dysmorphic Disorder, Borderline intellectual functioning, Borderline Personality Disorder, Breathing-Related Sleep Disorder, Brief Psychotic Disorder, Bruxism, Bulimia Nervosa, Caffeine Addiction, Cannabis Addiction, Catatonic disorder, Catatonic schizophrenia, Childhood amnesia, Childhood Disintegrative Disorder (now part of Autism Spectrum Disorder), Childhood Onset Fluency Disorder (formerly known as Stuttering), Circadian Rhythm Disorders, Claustrophobia, Cocaine related disorders, Communication disorder, Conduct Disorder, Conversion Disorder, Cotard delusion, Cyclothymia (also known as Cyclothymic Disorder), Delerium, Delusional Disorder, dementia, Dependent Personality Disorder (also known as Asthenic Personality Disorder), Depersonalization disorder (now known as Depersonalization/Derealization Disorder), Depression (also known as Major Depressive Disorder), Depressive personality disorder, Derealization disorder (now known as Depersonalization/Derealization Disorder), Dermotillomania, Desynchronosis, Developmental coordination disorder, Diogenes Syndrome, Disorder of written expression, Dispareunia, Dissocial Personality Disorder, Dissociative Amnesia, Dissociative Fugue, Dissociative Identity Disorder (formerly known as Multiple Personality Disorder), Down syndrome, Dyslexia, Dyspareunia, Dysthymia (now known as Persistent Depressive Disorder), Eating disorder NOS, Ekbom's Syndrome (Delusional Parasitosis), Emotionally unstable personality disorder, Encopresis, Enuresis (bedwetting), Erotomania, Exhibitionistic Disorder, Expressive language disorder, Factitious Disorder, Female Sexual Disorders, Fetishistic Disorder, Folie a deux, Fregoli delusion, Frotteuristic Disorder, Fugue State, Ganser syndrome, Gambling Addiction, Gender Dysphoria (formerly known as Gender Identity Disorder), Generalized Anxiety Disorder, General adaptation syndrome, Grandiose delusions, Hallucinogen Addiction, Haltlose personality disorder, Histrionic Personality Disorder, Primary hypersomnia, Huntington's Disease, Hypoactive sexual desire disorder, Hypochondriasis, Hypomania, Hyperkinetic syndrome, Hypersomnia, Hysteria, Impulse control disorder, Impulse control disorder NOS, Inhalant Addiction, Insomnia, Intellectual Development Disorder, Intermittent Explosive Disorder, Joubert syndrome, Kleptomania, Korsakoff s syndrome, Lacunar amnesia, Language Disorder, Learning Disorders, Major Depression (also known as Major Depressive Disorder), major depressive disorder, Male Sexual Disorders, Malingering, Mathematics disorder, Medication-related disorder, Melancholia, Mental Retardation (now known as Intellectual Development Disorder), Misophonia, Morbid jealousy, Multiple Personality Disorder (now known as Dissociative Identity Disorder), Munchausen Syndrome, Munchausen by Proxy, Narcissistic Personality Disorder, Narcolepsy, Neglect of child, Neurocognitive Disorder (formerly known as Dementia), Neuroleptic-related disorder, Nightmare Disorder, Non Rapid Eye Movement, Obsessive-Compulsive Disorder, Obsessive-Compulsive Personality Disorder (also known as Anankastic Personality Disorder), Oneirophrenia, Onychophagia, Opioid Addiction, Oppositional Defiant Disorder, Orthorexia (ON), Pain disorder, Panic attacks, Panic Disorder, Paranoid Personality Disorder, Parkinson's Disease, Partner relational problem, Passive-aggressive personality disorder, Pathological gambling, Pedophilic Disorder, Perfectionism, Persecutory delusion, Persistent Depressive Disorder (also known as Dysthymia), Personality change due to a general medical condition, Personality disorder, Pervasive developmental disorder (PDD), Phencyclidine related disorder, Phobic disorder, Phonological disorder, Physical abuse, Pica, Polysubstance related disorder, Postpartum Depression, Post-traumatic embitterment disorder (PTED), Post-Traumatic Stress Disorder, Premature ejaculation, Premenstrual Dysphoric Disorder, Psychogenic amnesia, Psychological factor affecting medical condition, Psychoneurotic personality disorder, Psychotic disorder, not otherwise specified, Pyromania, Reactive Attachment Disorder, Reading disorder, Recurrent brief depression, Relational disorder, REM Sleep Behavior Disorder, Restless Leg Syndrome, Retrograde amnesia, Retts Disorder (now part of Autism Spectrum Disorder), Rumination syndrome, Sadistic personality disorder, Schizoaffective Disorder, Schizoid Personality Disorder, Schizophrenia, Schizophreniform disorder, Schizotypal Personality Disorder, Seasonal Affective Disorder, Sedative, Hypnotic, or Anxiolytic Addiction, Selective Mutism, Self-defeating personality disorder, Separation Anxiety Disorder, Sexual Disorders Female, Sexual Disorders Male, Sexual Addiction, Sexual Masochism Disorder, Sexual Sadism Disorder, Shared Psychotic Disorder, Sleep Arousal Disorders, Sleep Paralysis, Sleep Terror Disorder (now part of Nightmare Disorder), Social Anxiety Disorder, Somatization Disorder, Specific Phobias, Stendhal syndrome, Stereotypic movement disorder, Stimulant Addiction, Stuttering (now known as Childhood Onset Fluency Disorder), Substance related disorder, Tardive dyskinesia, Tobacco Addiction, Tourettes Syndrome, Transient tic disorder, Transient global amnesia, Transvestic Disorder, Trichotillomania, Undifferentiated Somatoform Disorder, Vaginismus, and Voyeuristic Disorder.

Various lung diseases may be treated with pharmaceutical compositions, biocircuits, biocircuit components, effector modules including their SREs or payloads of the present invention. As a non-limiting example, the lung diseases may be Asbestosis, Asthma, Bronchiectasis, Bronchitis, Chronic Cough, Chronic Obstructive Pulmonary Disease (COPD), Croup, Cystic Fibrosis, Hantavirus, Idiopathic Pulmonary Fibrosis, Pertussis, Pleurisy, Pneumonia, Pulmonary Embolism, Pulmonary Hypertension, Sarcoidosis, Sleep Apnea, Spirometry, Sudden Infant Death Syndrome (SIDS), Tuberculosis, Alagille Syndrome, Autoimmune Hepatitis, Biliary Atresia, Cirrhosis, ERCP (Endoscopic Retrograde Cholangiopancreatography), and Hemochromatosis. Nonalcoholic Steatohepatitis, Porphyria, Primary Biliary Cirrhosis, Primary Sclerosing Cholangitis.

Various bone diseases may be treated with pharmaceutical compositions, biocircuits, biocircuit components, effector modules including their SREs or payloads of the present invention. As a non-limiting example, the bone diseases may be osteoporosis, neurofibromatosis, osteogenesis imperfecta (OI), rickets, osteosarcoma, achondroplasia, fracture, osteomyelitis, Ewing tumor of bone, osteomalacia, hip dysplasia, Paget disease of bone, marble bone disease, osteochondroma, bone cancer, bone disease, osteochondrosis, osteoma, fibrous dysplasia, cleidocranial dysostosis, osteoclastoma, bone cyst, metabolic bone disease, melorheostosis, callus, Caffey syndrome, and mandibulofacial dysostosis.

Various blood diseases may be treated with pharmaceutical compositions, biocircuits, biocircuit components, effector modules including their SREs or payloads of the present invention. As a non-limiting example, the blood diseases may be Anemia and CKD (for health care professionals), Aplastic Anemia and Myelodysplastic Syndromes, Deep Vein Thrombosis, Hemochromatosis, Hemophilia, Henoch-Schonlein Purpura, Idiopathic Thrombocytopenic Purpura, Iron-Deficiency Anemia, Pernicious Anemia, Pulmonary Embolism, Sickle Cell Anemia, Sickle Cell Trait and Other Hemoglobinopathies, Thalassemia, Thrombotic Thrombocytopenic Purpura, and Von Willebrand Disease.

In some embodiment, biocircuits of the invention may be used for the treatment of infectious diseases. Biocircuits of the invention may be introduced in cells suitable for adoptive cell transfer such as macrophages, dendritic cells, natural killer cells, and or T cells. Infectious diseases treated by the biocircuits of the invention may be diseases caused by viruses, bacteria, fungi, and/or parasites. IL15-IL15Ra payloads of the invention may be used to increase immune cell proliferation and/or persistence of the immune cells useful in treating infectious diseases.

6. Microbiome

Alterations in the composition of the microbiome may impact the action of anti-cancer therapies. A diverse community of symbiotic, commensal and pathogenic microorganisms exist in all environmentally exposed sites in the body and is herein referred to as the "Microbiome." Environmentally exposed sites of the body that may be inhabited by a microbiome include the skin, nasopharynx, the oral cavity, respiratory tract, gastrointestinal tract, and the reproductive tract.

In some embodiments, microbiome engineered with the biocircuits of the present invention may be used to improve the efficacy of the anti-cancer immunotherapies. Sivan et al., found that mice with *Bifidobacterium* in their gut microbiome were more responsive to immune check point blockage e.g. anti PD-L1 immunotherapy in subcutaneous melanoma tumor model (Sivan A., et al. Commensal *Bifidobacterium* promotes antitumor immunity and facilitates anti-PD-L1 efficacy. Science 2015; 350:1084-9; the contents of which are incorporated herein by reference in their entirety). In one embodiment, protein, RNA and/or other biomolecules derived from the microbiome may be used as a payload to influence the efficacy of the anti-cancer immunotherapies. In other embodiments, the microorganisms may be delivered along with immunotherapeutic compositions of the present invention to improve the efficacy of immunotherapy.

7. Tools and Agents for Making Therapeutics

Provided in the present invention are tools and agents that may be used in generating immunotherapeutics for reducing a tumor volume or burden in a subject in need. A considerable number of variables are involved in producing a therapeutic agent, such as structure of the payload, type of cells, method of gene transfers, method and time of ex vivo expansion, pre-conditioning and the amount and type of tumor burden in the subject. Such parameters may be optimized using tools and agents described herein.

Cell Lines

The present disclosure provides a mammalian cell that has been genetically modified with the compositions of the invention. Suitable mammalian cells include primary cells and immortalized cell lines. Suitable mammalian cell lines include, but are not limited to Human embryonic kidney cell line 293, fibroblast cell line NIH 3T3, human colorectal carcinoma cell line HCT116, ovarian carcinoma cell line SKOV-3, immortalized T cell lines Jurkat cells, lymphoma cell line Raji cells, NALM-6 cells, K562 cells, HeLa cells, PC12 cells, HL-60 cells, NK cell lines (e.g. NKL. NK962, and YTS), and the like. In some instances, the cell is not an immortalized cell line, but instead a cell obtained from an individual and is herein referred to as a primary cell. For example, the cell is a T lymphocyte obtained from an individual. Other examples include, but are not limited to cytotoxic cells, stem cells, peripheral blood mononuclear cells or progenitor cells obtained from an individual.

Tracking SREs, Biocircuits and Cell Lines

In some embodiments, it may be desirable to track the compositions of the invention or the cells modified by the compositions of the invention. Tracking may be achieved by using payloads such as reporter moieties, which, as used herein, refers to any protein capable of creating a detectable signal, in response to an input. Examples include alkaline phosphatase, β-galactosidase, chloramphenicol acetyltransferase, β-glucuronidase, peroxidase, β-lactamase, catalytic antibodies, bioluminescent proteins e.g. luciferase, and fluorescent proteins such as Green fluorescent protein (GFP).

Reporter moieties may be used to monitor the response of the DD upon addition of the ligand corresponding to the DD. In other instances, reporter moieties may be used to track cell survival, persistence, cell growth, and/or localization in vitro, in vivo, or ex vivo.

In some embodiments, the preferred reporter moiety may be luciferase proteins. In one embodiment, the reporter moiety is the Renilla luciferase, or a firefly luciferase.

Animal Models

The utility and efficacy of the compositions of the present invention may be tested in vivo animal models, preferably mouse models. Mouse models used to may be syngeneic mouse models wherein mouse cells are modified with compositions of the invention and tested in mice of the same genetic background. Examples include pMEL-1 and 4T1 mouse models. Alternatively, xenograft models where human cells such as tumor cells and immune cells are introduced into immunodeficient mice may also be utilized in such studies. Immunodeficient mice used may be CByJ.Cg-Foxn1$^{nu}$/J, B6; 129S7-Rag1$^{tm1Mom}$/J, B6.129S7-Rag1$^{tm1Mom}$/J, B6. CB 17-Prkdc$^{scid}$/SzJ, NOD. 129S7(B6)-Rag1$^{tm1Mom}$/J, NOD.Cg-Rag1$^{tm1Mom}$Prf1$^{tm1Sd}$z/Sz, NOD.CB 17-Prkdc$^{scid}$/SzJ, NOD. Cg-Prkdc$^{scid}$B2m$^{tm1Unc}$/J, NOD-scid IL2Rg$^{null}$, Nude (nu) mice, SCID mice, NOD mice, RAG1/RAG2 mice, NOD-Scid mice, IL2rgnull mice, b2mnull mice, NOD-scid IL2rγnull mice, NOD-scid-B2mnull mice, and HLA transgenic mice.

Cellular Assays

In some embodiments, the effectiveness of the compositions of the inventions as immunotherapeutic agents may be evaluated using cellular assays. Levels of expression and/or identity of the compositions of the invention may be determined according to any methods known in the art for identifying proteins and/or quantitating proteins levels. In some embodiments, such methods may include Western Blotting, flow cytometry, and immunoprecipitation.

Provided herein are methods for functionally characterizing cells expressing SRE, biocircuits and compositions of the invention. In some embodiments, functional characterization is carried out in primary immune cells or immortalized immune cell lines and may be determined by expression of cell surface markers. Examples of cell surface markers for T cells include, but are not limited to, CD3, CD4, CD8, CD 14, CD20, CD1 b, CD16, CD45 and HLA-DR, CD 69, CD28, CD44, IFNgamma. Examples of cell surface markers for antigen presenting cells include, but are not limited to, MHC class I, MHC Class II, CD40, CD45, B7-1, B7-2, IFN γ receptor and IL2 receptor, ICAM-1 and/or Fcγ receptor. Examples of cell surface markers for dendritic cells include, but are not limited to, MHC class I, MHC Class II, B7-2, CD18, CD29, CD31, CD43, CD44, CD45, CD54, CD58, CD83, CD86, CMRF-44, CMRF-56, DCIR and/or Dectin-1 and the like; while in some cases also having the absence of CD2, CD3, CD4, CD8, CD14, CD15, CD16, CD 19, CD20, CD56, and/or CD57. Examples of cell surface markers for NK cells include, but are not limited to, CCL3, CCL4, CCL5, Granulysin, Granzyme B, Granzyme K, IL10, IL22, IFNg, LAP, Perforin, and TNFa.

8. Gene Editing

The CRISPR-Cas9 system is a novel genome editing system which has been rapidly developed and implemented in a multitude of model organisms and cell types, and supplants other genome editing technologies, such as TALENs and ZFNs. CRISPRs are sequence motifs are present in bacterial and archaeal genomes, and are composed of short (about 24-48 nucleotide) direct repeats separated by similarly sized, unique spacers (Grissa et al. *BMC Bioinformatics* 8, 172 (2007). They are generally flanked by a set of CRISPR-associated (Cas) protein-coding genes that are required for CRISPR maintenance and function-(Barrangou et al., *Science* 315, 1709 (2007), Brouns et al., *Science* 321, 960 (2008), Haft et al. *PLoS Comput Biol* 1, e60 (2005)). CRISPR-Cas systems provide adaptive immunity against invasive genetic elements (e.g., viruses, phages and plasmids) (Horvath and Barrangou, *Science*, 2010, 327: 167-170; Bhaya et al., *Annu. Rev. Genet.*, 2011, 45: 273-297; and Brrangou R, *RNA*, 2013, 4: 267-278). Three different types of CRISPR-Cas systems have been classified in bacteria and the type II CRISPR-Cas system is most studied. In the bacterial Type II CRISPR-Cas system, small CRISPR RNAs (crRNAs) processed from the pre-repeat-spacer transcript (pre-crRNA) in the presence of a trans-activating RNA (tracrRNA)/Cas9 can form a duplex with the tracrRNA/Cas9 complex. The mature complex is recruited to a target double strand DNA sequence that is complementary to the spacer sequence in the tracrRNA: crRNA duplex to cleave the target DNA by Cas9 endonuclease (Garneau et al., *Nature*, 2010, 468: 67-71; Jinek et al., *Science*, 2012, 337: 816-821; Gasiunas et al., *Proc. Natl Acad. Sci. USA.*, 109: E2579-2586; and Haurwitz et al., *Science*, 2010, 329: 1355-1358). Target recognition and cleavage by the crRNA: tracrRNA/Cas9 complex in the type II CRISPR-CAS system not only requires a sequence in the tracrRNA: crRNA duplex that is a complementary to the target sequence (also called "protospacer" sequence) but also requires a protospacer adjacent motif (PAM) sequence located 3'end of the protospacer sequence of a target polynucleotide. The PAM motif can vary between different CRISPR-Cas systems.

CRISPR-Cas9 systems have been developed and modified for use in genetic editing and prove to be a high effective and specific technology for editing a nucleic acid sequence even in eukaryotic cells. Many researchers disclosed various modifications to the bacterial CRISPR-Cas systems and demonstrated that CRISPR-Cas systems can be used to manipulate a nucleic acid in a cell, such as in a mammalian cell and in a plant cell. Representative references include U.S. Pat. Nos. 8,993,233; 8,999,641; 8,945,839; 8, 932,814; 8,906, 616; 8,895,308; 8,889,418; 8,889,356; 8,871,445; 8,865,406; 8,771,945; and 8,697,359; US patent publication NOs.: 20150031134; 20150203872; 20150218253; 20150176013; 20150191744; 20150071889; 20150067922; and 20150167000; each of which is incorporated herein by reference in their entirety.

However, controlling the effects and activity of the CRISPR-Cas system (e.g., guide RNA and nuclease) has been challenging and often can be problematic.

The biocircuits of the present invention and/or any of their components may be utilized in regulating or tuning the CRISPR/Cas9 system to optimize its utility.

In some embodiments, the payloads of the effector modules of the invention may include alternative isoforms or orthologs of the Cas9 enzyme.

The most commonly used Cas9 is derived from *Streptococcus pyogenes* and the RuvC domain can be inactivated by a D10A mutation and the HNH domain can be inactivated by an H840A mutation.

In addition to Cas9 derived from *S. pyogenes*, other RNA guided endonucleases (RGEN) may also be used for programmable genome editing. Cas9 sequences have been identified in more than 600 bacterial strains. Though Cas9 family shows high diversity of amino acid sequences and protein sizes, All Cas9 proteins share a common architecture with a central HNH nuclease domain and a split RuvC/ RHase H domain. Examples of Cas9 orthologs from other bacterial strains including but not limited to, Cas proteins identified in *Acaryochloris marina* MBIC 11017; *Acetohalobium arabaticum* DSM 5501; *Acidithiobacillus caldus;* *Acidithiobacillus ferrooxidans* ATCC 23270; *Alicyclobacillus acidocaldarius* LAA1; *Alicyclobacillus acidocaldarius* subsp. *acidocaldarius* DSM 446; *Allochromatium vinosum* DSM 180; *Ammonifex degensii* KC4; *Anabaena variabilis* ATCC 29413; *Arthrospira maxima* CS-328; *Arthrospira platensis* str. Paraca; *Arthrospira* sp. PCC 8005; *Bacillus pseudomycoides* DSM 12442; *Bacillus selenitireducens* MLS10; *Burkholderiales bacterium* 1_1_47; *Caldicelulosiruptor becscii* DSM 6725; *Candidatus Desulforudis audaxviator* MP104C; *Caldicellulosiruptor hydrothermalis_108*; *Clostridium phage* c-st; *Clostridium botulinum* A3 str. Loch Maree; *Clostridium botulinum* Ba4 str. 657; *Clostridium difficile* QCD-63q42; *Crocosphaera watsonii* WH 8501; *Cyanothece* sp. ATCC 51142; *Cyanothece* sp. CCY0110; *Cyanothece* sp. PCC 7424; *Cyanothece* sp. PCC 7822; *Exiguobacterium sibiricum* 255-15; *Finegoldia magna* ATCC 29328; *Ktedonobacter racemifer* DSM 44963; *Lactobacillus delbrueckii* subsp. *bulgaricus* PB2003/044-T3-4; *Lactobacillus salivarius* ATCC 11741; *Listeria innocua; Lyngbya* sp. PCC 8106; *Marinobacter* sp. ELB 17; *Methanohalobium evestigatum* Z-7303; *Microcystis phage* Ma-LMMO1; *Microcystis aeruginosa* NIES-843; *Microscilla marina* ATCC 23134; *Microcoleus chthonoplastes* PCC 7420; *Neisseria meningitidis; Nitrosococcus halophilus* Nc4; *Nocardiopsis dassonvillei* subsp. *dassonvillei* DSM 43111; *Nodularia spumigena* CCY9414; *Nostoc* sp. PCC 7120; *Oscillatoria* sp. PCC 6506; *Pelotomaculum thermopropionicum* SI; *Petrotoga mobilis* SJ95; *Polaromonas naphthalenivorans* CJ2; *Polaromonas* sp. JS666; *Pseudoalteromonas haloplanktis* TAC 125; *Streptomyces pristinaespiralis* ATCC 25486; *Streptomyces pristinaespiralis* ATCC 25486; *Streptococcus thermophilus; Streptomyces viridochromogenes* DSM 40736; *Streptosporangium*

*roseum* DSM 43021; *Synechococcus* sp. PCC 7335; and *Thermosipho africanus* TCF52B (Chylinski et al., *RNA Biol.*, 2013; 10(5): 726-737).

In addition to Cas9 orthologs, other Cas9 variants such as fusion proteins of inactive dCas9 and effector domains with different functions may be served as a platform for genetic modulation. Any of the foregoing enzymes may be useful in the present invention.

9. Stem Cell Applications

The biocircuits of the present invention and/or any of their components may be utilized in the regulated reprogramming of cells, stem cell engraftment or other application where controlled or tunable expression of such reprogramming factors are useful.

The biocircuits of the present invention may be used in reprogramming cells including stem cells or induced stem cells. Induction of induced pluripotent stem cells (iPSC) was first achieved by Takahashi and Yamanaka (*Cell*, 2006. 126(4):663-76; herein incorporated by reference in its entirety) using viral vectors to express KLF4, c-MYC, OCT4 and SOX2 otherwise collectively known as KMOS.

Excisable lentiviral and transposon vectors, repeated application of transient plasmid, episomal and adenovirus vectors have also been used to try to derive iPSC (Chang, C.-W., et al., *Stem Cells*, 2009. 27(5):1042-1049; Kaji, K., et al., *Nature*, 2009. 458(7239):771-5; Okita, K., et al., *Science*, 2008. 322(5903):949-53; Stadtfeld, M., et al., *Science*, 2008. 322(5903):945-9; Woltjen, K., et al., *Nature*, 2009; Yu, J., et al., *Science*, 2009:1172482; Fusaki, N., et al., *Proc Jpn Acad Ser B Phys Biol Sci*, 2009. 85(8):348-62; each of which is herein incorporated by reference in its entirety).

DNA-free methods to generate human iPSC has also been derived using serial protein transduction with recombinant proteins incorporating cell-penetrating peptide moieties (Kim, D., et al., *Cell Stem Cell*, 2009. 4(6): 472-476; Zhou, H., et al., *Cell Stem Cell*, 2009. 4(5):381-4; each of which is herein incorporated by reference in its entirety), and infectious transgene delivery using the Sendai virus (Fusaki, N., et al., *Proc Jpn Acad Ser B Phys Biol Sci*, 2009. 85(8): p. 348-62; herein incorporated by reference in its entirety).

The effector modules of the present invention may include a payload comprising any of the genes including, but not limited to, OCT such as OCT4, SOX such as SOX1, SOX2, SOX3, SOX15 and SOX18, NANOG, KLF such as KLF1, KLF2, KLF4 and KLF5, MYC such as c-MYC and n-MYC, REM2, TERT and LIN28 and variants thereof in support of reprogramming cells. Sequences of such reprogramming factors are taught in for example International Application PCT/US2013/074560, the contents of which are incorporated herein by reference in their entirety.

In some embodiments, the payload of the present invention may be cardiac lineage specification factors such as eomesodermin (EOMES), a T-box transcription factor; WNT signaling pathway components such as WNT3 and WNT 3A. EOMES is crucially required for the development of the heart. Cardiomyocyte programming by EOMES involves autocrine activation of the canonical WNT signaling pathway and vice versa. Under conditions that are conducive to promoting cardiac lineage, WNT signaling activates EOMES and EOMES in turn promotes WNT signaling creating a self-sustaining loop that promotes the cardiac lineage. An activation loop that is too weak or too strong promotes non-cardiac fates such as endodermal and other mesodermal fates respectively. The DDs of the present invention may be used to tune EOMES and WNT payload levels to generate an activation loop that initiate and/or sustain cardiac specification during gastrulation.

VII. DEFINITIONS

At various places in the present specification, features or functions of the compositions of the present disclosure are disclosed in groups or in ranges. It is specifically intended that the present disclosure include each and every individual sub-combination of the members of such groups and ranges. The following is a non-limiting list of term definitions.

Activity: As used herein, the term "activity" refers to the condition in which things are happening or being done. Compositions of the invention may have activity and this activity may involve one or more biological events. In some embodiments, biological events may include cell signaling events. In some embodiments, biological events may include cell signaling events associated protein interactions with one or more corresponding proteins, receptors, small molecules or any of the biocircuit components described herein.

Adoptive cell therapy (ACT): The terms "Adoptive cell therapy" or "Adoptive cell transfer", as used herein, refer to a cell therapy involving in the transfer of cells into a patient, wherein cells may have originated from the patient, or from another individual, and are engineered (altered) before being transferred back into the patient. The therapeutic cells may be derived from the immune system, such as Immune effector cells: CD4+ T cell; CD8+ T cell, Natural Killer cell (NK cell); and B cells and tumor infiltrating lymphocytes (TILs) derived from the resected tumors. Most commonly transferred cells are autologous anti-tumor T cells after ex vivo expansion or manipulation. For example, autologous peripheral blood lymphocytes can be genetically engineered to recognize specific tumor antigens by expressing T-cell receptors (TCR) or chimeric antigen receptor (CAR).

Agent: As used herein, the term "agent" refers to a biological, pharmaceutical, or chemical compound. Non-limiting examples include simple or complex organic or inorganic molecule, a peptide, a protein, an oligonucleotide, an antibody, an antibody derivative, antibody fragment, a receptor, and soluble factor.

Agonist: the term "agonist" as used herein, refers to a compound that, in combination with a receptor, can produce a cellular response. An agonist may be a ligand that directly binds to the receptor. Alternatively, an agonist may combine with a receptor indirectly by, for example, (a) forming a complex with another molecule that directly binds to the receptor, or (b) otherwise resulting in the modification of another compound so that the other compound directly binds to the receptor. An agonist may be referred to as an agonist of a particular receptor or family of receptors, e.g., agonist of a co-stimulatory receptor.

Antagonist: the term "antagonist" as used herein refers to any agent that inhibits or reduces the biological activity of the target(s) it binds.

Antigen: the term "antigen" as used herein is defined as a molecule that provokes an immune response when it is introduced into a subject or produced by a subject such as tumor antigens which arise by the cancer development itself. This immune response may involve either antibody production, or the activation of specific immunologically-competent cells such as cytotoxic T lymphocytes and T helper cells, or both. An antigen can be derived from organisms, subunits of proteins/antigens, killed or inactivated whole cells or lysates. In the context of the invention, the terms "antigens of interest" or "desired antigens" refers to those proteins and/or other biomolecules provided herein that are immunospecifically bound or interact with antibodies of the present invention and/or fragments, mutants, variants, and/ or alterations thereof described herein. In some embodiments, antigens of interest may comprise any of the polypeptides or payloads or proteins described herein, or fragments or portions thereof.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Alkyl: The terms "alkyl", "alkoxy", "hydroxyalkyl", "alkoxy alkyl", and "alkoxy carbonyl", as used herein, include both straight and branched chains containing one to twelve carbon atoms, and/or which may or may not be substituted.

Alkenyl: The terms "alkenyl" and "alkynyl" as used herein alone or as part of a larger moiety shall include both straight and branched chains containing two to twelve carbon atoms.

Aryl: The term "aryl" as used herein alone or as part of a larger moiety as in "aralkyl", "aralkoxy", or "aryloxyalkyl", refers to monocyclic, bicyclic and tricyclic carbocyclic ring systems having a total of five to fourteen ring members, wherein at least one ring is aromatic and wherein each ring in the system contains 3 to 8 ring members. The term "aryl" may be used interchangeably with the term "aryl ring."

Aromatic: The term "aromatic" as used herein, refers to an unsaturated hydrocarbon ring structure with delocalized pi electrons. As used herein "aromatic" may refer to monocyclic, bicyclic or polycyclic aromatic compounds.

Aliphatic: The term "aliphatic" or "aliphatic group" as used herein, refers to a straight or branched C1-C8 hydrocarbon chain or a monocyclic C3-C8hydrocarbon or bicyclic C8-C12 hydrocarbon which are fully saturated or that contains one or more units of unsaturation, that is completely saturated or that contains one or more units of unsaturation, but which is not aromatic (also referred to herein as "carbocycle" or "cycloalkyl"), and that has a single point of attachment to the rest of the molecule wherein any individual ring in said bicyclic ring system has 3-7 members.

Associated with: As used herein, the terms "associated with," "conjugated," "linked," "attached," and "tethered," when used with respect to two or more moieties, mean that the moieties are physically associated or connected with one another, either directly or via one or more additional moieties that serve as linking agents, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Autologous: the term "autologous" as used herein is meant to refer to any material derived from the same individual to which it is later to be re-introduced into the individual.

Barcode: the term "barcode" as used herein refers to polynucleotide or amino acid sequence that distinguishes one polynucleotide or amino acid from another.

Biocircuit system: As used herein, a "biocircuit" or "biocircuit system" is defined as a circuit within or useful in biologic systems comprising a stimulus and at least one effector module responsive to a stimulus, where the response to the stimulus produces at least one signal or outcome within, between, as an indicator of, or on a biologic system. Biologic systems are generally understood to be any cell, tissue, organ, organ system or organism, whether animal, plant, fungi, bacterial, or viral. It is also understood that biocircuits may be artificial circuits which employ the stimuli or effector modules taught by the present invention and effect signals or outcomes in acellular environments such as with diagnostic, reporter systems, devices, assays or kits. The artificial circuits may be associated with one or more electronic, magnetic, or radioactive components or parts. In the context of the present invention, a biocircuit includes a destabilizing domain (DD) biocircuit system.

Checkpoint factor: As used herein, a checkpoint factor is any moiety or molecule whose function acts at the junction of a process. For example, a checkpoint protein, ligand or receptor may function to stall or accelerate the cell cycle.

Co-stimulatory molecule: As used herein, in accordance with its meaning in immune T cell activation, refers to a group of immune cell surface receptor/ligands which engage between T cells and APCs and generate a stimulatory signal in T cells which combines with the stimulatory signal in T cells that results from T cell receptor (TCR) recognition of antigen/MHC complex (pMHC) on APCs Cytokines: the term "cytokines", as used herein, refers to a family of small soluble factors with pleiotropic functions that are produced by many cell types that can influence and regulate the function of the immune system.

Delivery: the term "delivery" as used herein refers to the act or manner of delivering a compound, substance, entity, moiety, cargo or payload. A "delivery agent" refers to any agent which facilitates, at least in part, the in vivo delivery of one or more substances (including, but not limited to compounds and/or compositions of the present invention) to a cell, subject or other biological system cells.

Destabilized: As used herein, the term "destable," "destabilize," "destabilizing region" or "destabilizing domain" means a region or molecule that is less stable than a starting, reference, wild-type or native form of the same region or molecule.

Engineered: As used herein, embodiments of the invention are "engineered" when they are designed to have a feature or property, whether structural or chemical, that varies from a starting point, wild type or native molecule.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; (4) folding of a polypeptide or protein; and (5) post-translational modification of a polypeptide or protein.

Feature: As used herein, a "feature" refers to a characteristic, a property, or a distinctive element.

Formulation: As used herein, a "formulation" includes at least a compound and/or composition of the present invention and a delivery agent.

Fragment: A "fragment," as used herein, refers to a portion. For example, fragments of proteins may comprise polypeptides obtained by digesting full-length protein. In some embodiments, a fragment of a protein includes at least 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, 250 or more amino acids. In some embodiments, fragments of an antibody include portions of an antibody.

Functional: As used herein, a "functional" biological molecule is a biological entity with a structure and in a form in which it exhibits a property and/or activity by which it is characterized.

Heterocycle: The term "heterocycle", "heterocyclyl", or "heterocyclic" as used herein refers to monocyclic, bicyclic or tricyclic ring systems having three to fourteen ring members in which one or more ring members is a heteroatom, wherein each ring in the system contains 3 to 7 ring members and is non-aromatic.

Hotspot: As used herein, a "hotspot" or a "mutational hotspot" refers to an amino acid position in a protein coding gene that is mutated (by substitutions) more frequently relative to elsewhere within the same gene.

Hydrophilic: As used herein, "hydrophilic" refers to a molecule that interacts with or has affinity for water.

Hydrophobic. As used herein, "hydrophobic" refers to a molecule that does not interact or have affinity for water.

Immune cells: the term "an immune cell", as used herein, refers to any cell of the immune system that originates from a hematopoietic stem cell in the bone marrow, which gives rise to two major lineages, a myeloid progenitor cell (which give rise to myeloid cells such as monocytes, macrophages, dendritic cells, megakaryocytes and granulocytes) and a lymphoid progenitor cell (which give rise to lymphoid cells such as T cells, B cells and natural killer (NK) cells). Exemplary immune system cells include a CD4+ T cell, a CD8+ T cell, a CD4−CD8− double negative T cell, a T γδ cell, a Tαβ cell, a regulatory T cell, a natural killer cell, and a dendritic cell. Macrophages and dendritic cells may be referred to as "antigen presenting cells" or "APCs," which are specialized cells that can activate T cells when a major histocompatibility complex (MHC) receptor on the surface of the APC complexed with a peptide interacts with a TCR on the surface of a T cell.

Immunotherapy: the term "immunotherapy" as used herein, refers to a type of treatment of a disease that uses immunological tools, such as monoclonal antibodies, receptor-immunoglobulin fusion proteins, vaccines and/or immune cells.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Linker: As used herein, a linker refers to a moiety that connects two or more domains, moieties or entities. In one embodiment, a linker may comprise 10 or more atoms. In a further embodiment, a linker may comprise a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. In some embodiments, a linker may comprise one or more nucleic acids comprising one or more nucleotides. In some embodiments, the linker may comprise an amino acid, peptide, polypeptide or protein. In some embodiments, a moiety bound by a linker may include, but is not limited to an atom, a chemical group, a nucleoside, a nucleotide, a nucleobase, a sugar, a nucleic acid, an amino acid, a peptide, a polypeptide, a protein, a protein complex, a payload (e.g., a therapeutic agent), or a marker (including, but not limited to a chemical, fluorescent, radioactive or bioluminescent marker). The linker can be used for any useful purpose, such as to form multimers or conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers, Other examples include, but are not limited to, cleavable moieties within the linker, such as, for example, a disulfide bond (—S—S—) or an azo bond (—N═N—), which can be cleaved using a reducing agent or photolysis. Non-limiting examples of a selectively cleavable bonds include an amido bond which may be cleaved for example by the use of tris(2-carboxyethyl) phosphine (TCEP), or other reducing agents, and/or photolysis, as well as an ester bond which may be cleaved for example by acidic or basic hydrolysis.

Lipophilic: As used herein, the term "lipophilic" refers to an affinity for lipids or fats.

Metabolite: Metabolites are the intermediate products of metabolic reactions catalyzed by enzymes that naturally occur within cells. This term is usually used to describe small molecules, fragments of larger biomolecules or processed products.

Modified: As used herein, the term "modified" refers to a changed state or structure of a molecule or entity as compared with a parent or reference molecule or entity. Molecules may be modified in many ways including chemically, structurally, and functionally. In some embodiments, compounds and/or compositions of the present invention are modified by the introduction of non-natural amino acids.

Mutation: As used herein, the term "mutation" refers to a change and/or alteration. In some embodiments, mutations may be changes and/or alterations to proteins (including peptides and polypeptides) and/or nucleic acids (including polynucleic acids). In some embodiments, mutations comprise changes and/or alterations to a protein and/or nucleic acid sequence. Such changes and/or alterations may comprise the addition, substitution and or deletion of one or more amino acids (in the case of proteins and/or peptides) and/or nucleotides (in the case of nucleic acids and or polynucleic acids). In some embodiments, wherein mutations comprise the addition and/or substitution of amino acids and/or nucleotides, such additions and/or substitutions may comprise 1 or more amino acid and/or nucleotide residues and may include modified amino acids and/or nucleotides. The resulting construct, molecule or sequence of a mutation, change or alteration may be referred to herein as a mutant.

Neoantigen: the term "neoantigen", as used herein, refers to a tumor antigen that is present in tumor cells but not normal cells and do not induce deletion of their cognate antigen specific T cells in thymus (i.e., central tolerance). These tumor neoantigens may provide a "foreign" signal, similar to pathogens, to induce an effective immune response needed for cancer immunotherapy. A neoantigen may be restricted to a specific tumor. A neoantigen be a peptide/protein with a missense mutation (missense neoantigen), or a new peptide with long, completely novel stretches of amino acids from novel open reading frames (neoORFs). The neoORFs can be generated in some tumors by out-of-frame insertions or deletions (due to defects in DNA mismatch repair causing microsatellite instability), gene-fusion, read-through mutations in stop codons, or translation of improperly spliced RNA (e.g., Saeterdal et al., Proc Natl Acad Sci USA, 2001, 98: 13255-13260).

Off-target: As used herein, "off target" refers to any unintended effect on any one or more target, gene, cellular transcript, cell, and/or tissue.

Operably linked: As used herein, the phrase "operably linked" refers to a functional connection between two or more molecules, constructs, transcripts, entities, moieties or the like.

Phenyl: As used herein, "phenyl" refers to a cyclic group of atoms with a formula $C_6H_5$.

Payload or payload of interest (POI): the terms "payload" and "payload of interest (POI)", as used herein, are used interchangeable. A payload of interest (POI) refers to any protein or compound whose function is to be altered. In the context of the present invention, the POI is a component in the immune system, including both innate and adaptive immune systems. Payloads of interest may be a protein, a fusion construct encoding a fusion protein, or non-coding gene, or variant and fragment thereof. Payload of interest may, when amino acid based, may be referred to as a protein of interest.

Pharmaceutically acceptable excipients: the term "pharmaceutically acceptable excipient," as used herein, refers to any ingredient other than active agents (e.g., as described herein) present in pharmaceutical compositions and having the properties of being substantially nontoxic and non-inflammatory in subjects. In some embodiments, pharmaceutically acceptable excipients are vehicles capable of suspending and/or dissolving active agents. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, cross-linked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: Pharmaceutically acceptable salts of the compounds described herein are forms of the disclosed compounds wherein the acid or base moiety is in its salt form (e.g., as generated by reacting a free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. Pharmaceutically acceptable salts include the conventional non-toxic salts, for example, from non-toxic inorganic or organic acids. In some embodiments, a pharmaceutically acceptable salt is prepared from a parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in Remington's Pharmaceutical Sciences, 17th ed., Mack Publishing Company, Easton, Pa., 1985, p. 1418, Pharmaceutical Salts: Properties, Selection, and Use, P. H. Stahl and C. G. Wermuth (eds.), Wiley-VCH, 2008, and Berge et al., Journal of Pharmaceutical Science, 66, 1-19 (1977), each of which is incorporated herein by reference in its entirety. Pharmaceutically acceptable solvate: The term "pharmaceutically acceptable solvate," as used herein, refers to a crystalline form of a compound wherein molecules of a suitable solvent are incorporated in the crystal lattice. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N, N'-dimethylformamide (DMF), N, N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate." In some embodiments, the solvent incorporated into a solvate is of a type or at a level that is physiologically tolerable to an organism to which the solvate is administered (e.g., in a unit dosage form of a pharmaceutical composition).

Piperazine: As used herein, "piperazine" refers to a six membered ring containing two nitrogen atoms at opposite positions in the ring.

Protein of interest: As used herein, the terms "proteins of interest" or "desired proteins" include those provided herein and fragments, mutants, variants, and alterations thereof.

Purine: As used herein, "purine" refers to an aromatic heterocyclic structure, wherein one of the heterocycles is an imidazole ring and one of the heterocycles is a pyrimidine ring.

Pyrimidine: As used herein, "pyrimidine" refers to an aromatic heterocyclic structure similar to benzene, but wherein two of the carbon atoms are replaced by nitrogen atoms.

Pyridopyrimidine: As used herein, "Pyridopyrimidine" refers to an aromatic heterocyclic structure, wherein one of the heterocycles is a purine ring and one of the heterocycles is a pyrimidine ring.

Quinazoline: As used herein, the term, "Quinazoline" refers to an aromatic heterocyclic structure, wherein one of the heterocycles is a benzene ring and one of the heterocycles is a pyrimidine ring.

Stable: As used herein "stable" refers to a compound or entity that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable. In some embodiments, stability is measured relative to an absolute value. In some embodiments, stability is measured relative to a secondary status or state or to a reference compound or entity.

Standard CAR: As used herein, the term "standard CAR" refers to the standard design of a chimeric antigen receptor. The components of a CAR fusion protein including the extracellular scFv fragment, transmembrane domain and one or more intracellular domains are linearly constructed as a single fusion protein.

Stimulus response element (SRE): the term "stimulus response element (SRE), as used herein, is a component of an effector module which is joined, attached, linked to or associated with one or more payloads of the effector module and in some instances, is responsible for the responsive nature of the effector module to one or more stimuli. As used herein, the "responsive" nature of an SRE to a stimulus may be characterized by a covalent or non-covalent interaction, a direct or indirect association or a structural or chemical reaction to the stimulus. Further, the response of any SRE to a stimulus may be a matter of degree or kind. The response may be a partial response. The response may be a reversible response. The response may ultimately lead to a regulated signal or output. Such output signal may be of a relative nature to the stimulus, e.g., producing a modulatory effect of between 1 and 100 or a factored increase or decrease such as 2-fold, 3-fold, 4-fold, 5-fold, 10-fold or more. One non-limiting example of an SRE is a destabilizing domain (DD).

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

T cell: A T cell is an immune cell that produces T cell receptors (TCRs). T cells can be naïve (not exposed to antigen; increased expression of CD62L, CCR7, CD28, CD3, CD127, and CD45RA, and decreased expression of CD45RO as compared to TCM), memory T cells (TM) (antigen-experienced and long-lived), and effector cells (antigen-experienced, cytotoxic). TM can be further divided into subsets of central memory T cells (TCM, increased expression of CD62L, CCR7, CD28, CD127, CD45RO, and CD95, and decreased expression of CD54RA as compared to naïve T cell and effector memory T cells ($T_{EM}$, decreased expression of CD62L, CCR7, CD28, CD45RA, and increased expression of CD127 as compared to naïve T cells or TCM). Effector T cells (TE) refers to antigen-experienced CD8+ cytotoxic T lymphocytes that have decreased expression of CD62L, CCR7, CD28, and are positive for granzyme and perforin as compared to TCM. Other exemplary T cells include regulatory T cells, such as CD4+ CD25+ (Foxp3+) regulatory T cells and Treg17 cells, as well as Tr1, Th3, CD8+CD28−, and Qa-1 restricted T cells.

T cell receptor: T cell receptor (TCR) refers to an immunoglobulin superfamily member having a variable antigen binding domain, a constant domain, a transmembrane region, and a short cytoplasmic tail, which is capable of specifically binding to an antigen peptide bound to a MHC receptor. A TCR can be found on the surface of a cell or in soluble form and generally is comprised of a heterodimer having α and β chains (also known as TCRα and TCRβ, respectively), or γ and δ chains (also known as TCRγ and TCRδ, respectively). The extracellular portion of TCR chains (e.g., α-chain, β-chain) contains two immunoglobulin domains, a variable domain (e.g., α-chain variable domain or Vα, β-chain variable domain or Vβ) at the N-terminus, and one constant domain (e.g., α-chain constant domain or Cα and β-chain constant domain or Cβ) adjacent to the cell membrane. Similar to immunoglobulin, the variable domains contain complementary determining regions (CDRs) separated by framework regions (FRs). A TCR is usually associated with the CD3 complex to form a TCR complex. As used herein, the term "TCR complex" refers to a complex formed by the association of CD3 with TCR. For example, a TCR complex can be composed of a CD3γ chain, a CD3δ chain, two CD3ε chains, a homodimer of CD3ζ chains, a TCRα chain, and a TCRβ chain. Alternatively, a TCR complex can be composed of a CD3γ chain, a CD3δ chain, two CD3ε chains, a homodimer of CD3ζ chains, a TCRγ chain, and a TCRδ chain. A "component of a TCR complex," as used herein, refers to a TCR chain (i.e., TCRα, TCRβ, TCRγ or TCRδ), a CD3 chain (i.e., CD3γ, CD3δ, CD3ε or CD3ζ), or a complex formed by two or more TCR chains or CD3 chains (e.g., a complex of TCRα and TCRβ, a complex of TCRγ and TCRδ, a complex of CD3ε and CD3δ, a complex of CD3γ and CD3ε, or a sub-TCR complex of TCRα, TCRβ, CD3γ, CD3δ, and two CD3ε chains.

Therapeutic Agent: The term "therapeutic agent" refers to any agent that, when administered to a subject, has a therapeutic, diagnostic, and/or prophylactic effect and/or elicits a desired biological and/or pharmacological effect. Therapeutic agents of the present invention include any of the biocircuit components taught herein either alone or in combination with other therapeutic agents.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition. In some embodiments, a therapeutically effective amount is provided in a single dose. In some embodiments, a therapeutically effective amount is administered in a dosage regimen comprising a plurality of doses. Those skilled in the art will appreciate that in some embodiments, a unit dosage form may be considered to comprise a therapeutically effective amount of a particular agent or entity if it comprises an amount that is effective when administered as part of such a dosage regimen.

Triazine: As used herein, "triazine" is a class of nitrogen containing heterocycles with a structure similar to benzene, but wherein three carbon atoms are replaced by nitrogen atoms.

Treatment or treating: As used herein, the terms "treatment" or "treating" denote an approach for obtaining a beneficial or desired result including and preferably a beneficial or desired clinical result. Such beneficial or desired clinical results include, but are not limited to, one or more of the following: reducing the proliferation of (or destroying) cancerous cells or other diseased, reducing metastasis of cancerous cells found in cancers, shrinking the size of the tumor, decreasing symptoms resulting from the disease, increasing the quality of life of those suffering from the disease, decreasing the dose of other medications required to treat the disease, delaying the progression of the disease, and/or prolonging survival of individuals.

Tune: As used herein, the term "tune" means to adjust, balance or adapt one thing in response to a stimulus or toward a particular outcome. In one non-limiting example, the SREs and/or DDs of the present invention adjust, balance or adapt the function or structure of compositions to which they are appended, attached or associated with in response to particular stimuli and/or environments.

Variant: As used herein, the term "variant" refers to a first composition (e.g., a first DD or payload), that is related to a second composition (e.g., a second DD or payload, also termed a "parent" molecule). The variant molecule can be derived from, isolated from, based on or homologous to the parent molecule. The term variant can be used to describe either polynucleotides or polypeptides.

VIII. EQUIVALENTS AND SCOPE

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any antibiotic, therapeutic or active ingredient; any method of production; any method of use; etc.) can be excluded from any one or more claims, for any reason, whether or not related to the existence of prior art.

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention. The present invention is further illustrated by the following nonlimiting examples.

EXAMPLES

Example 1. Generation of Novel Ligand Responsive DDs by Mutagenesis Screening Study Design To engineer constructs that display ligand dependent stability, a candidate ligand binding domain (LBD) is selected and a cell-based screen using yellow fluorescent protein (YFP) as a reporter for protein stability is designed to identify mutants of the candidate LBD possessing the desired characteristics of a destabilizing domain: low protein levels in the absence of a ligand of the LBD, (i.e., low basal stability), large dynamic range, robust and predictable dose-response behavior, and rapid kinetics of degradation (Banaszynski, et al., (2006) *Cell;* 126(5): 995-1004). The candidate LBD binds to a desired ligand but not endogenous signaling molecules.

The candidate LBD sequence (as a template) is first mutated using a combination of nucleotide analog mutagenesis and error-prone PCR, to generate libraries of mutants based on the template candidate domain sequence. The libraries generated are cloned in-frame at either the 5'- or 3'-ends of the YFP gene, and a retroviral expression system is used to stably transduce the libraries of YFP fusions into NIH3T3 fibroblasts.

The transduced NIH3T3 cells are subjected to three to four rounds of sorting using fluorescence-activated cell sorting (FACS) to screen the libraries of candidate DDs. Transduced NIH3T3 cells are cultured in the absence of the high affinity ligand of the ligand binding domain (LBD), and cells that exhibit low levels of YFP expression are selected through FACS.

Screening Strategy I

The selected cell population is cultured in the presence of the high affinity ligand of the ligand binding domain for a period of time (e.g., 24 hours), at which point cells are sorted again by FACS. Cells that exhibit high levels of YFP expression are selected through FACS and the selected cell population is split into two groups and treated again with the high affinity ligand of the ligand binding domain at different concentrations; one group is treated with the lower concentration of the ligand and the other is treated with a high concentration of the ligand, for a period of time (e.g., 24 hours), at which point cells are sorted again by FACS. Cells expressing mutants that are responsive to lower concentrations of the ligand are isolated.

The isolated cells responsive to the lower concentration of the ligand are treated with the ligand again and cells exhibiting low fluorescence levels are collected 4 hours following removal of the ligand from the media. This fourth sorting is designed to enrich cells that exhibit fast kinetics of degradation (Iwamoto et al., Chem Biol. 2010 Sep. 24; 17(9): 981-988).

Screening Strategy II

The selected cell population is subject to additional one or more sorts by FACS in the absence of high affinity ligand of LBD and cells that exhibit low levels of YFP expression are selected for further analysis. Cells are treated with high affinity ligand of the ligand binding domain, for a period of time (e.g. 24 hours), and sorted again by FACS. Cells expressing high levels of YFP are selected for through FACS. Cells with high expression of YFP are treated with ligand again and cells exhibiting low fluorescence levels are collected 4 hours following removal of the ligand from the media to enrich cells that exhibit fast kinetics of degradation. Any of the sorting steps may be repeated to identify DDs with ligand dependent stability.

The cells are recovered after sorting. The identified candidate cells are harvested and the genomic DNA is extracted. The candidate DDs are amplified by PCR and isolated. The candidate DDs are sequenced and compared to the LBD template to identify the mutations in candidate DDs.

Example 2. Novel DDs Derived from Human PDE5 by Site Directed Mutagenesis

To identify novel destabilizing domain mutations, mutagenic PCR was performed on the open reading frame of human PDE5 catalytic domain (SEQ ID NO. 3) using non-natural nucleotides. The mutant library was ligated in frame with an AcGFP reporter at C-terminus and cloned into pLVX-IRES-Puro vectors. The lentivirus library was then used to infect HEK 293T cells. Cells were selected with puromycin and the library was screened using screening strategies described in Example 1. DNA was extracted from the cell pool, cloned into vectors, and transformed into E. coli. Individual clones were sequenced and cloned in frame with a linker GGSGGGSGG (SEQ ID NO. 77) and AcGFP at C terminus into pLVX.IRES puro. The catalytic domain of wildtype hPDE5 was also cloned into pLVX.IRES. Puro and used as a control. HEK293 cells were transduced with individual clones and selected with puromycin.

HEK293 cells expressing OT-hPDE5N constructs were incubated with 10 µM Sildenafil or vehicle control, DMSO for 48 hours and the stability of hPDE5 mutants was evaluated at the protein level. Cell lysates obtained from hPDE5N construct expressing cells were immunoblotted using the AcGFP antibody (Clonetech, Mountain View, Calif.). Samples were also immunoblotted with the GAPDH antibody to ensure uniform protein loading. The immunoblot demonstrated that OT-hPDE5N-002, OT-hPDE5N-003, OT-hPDE5N-006, OT-hPDE5N-008, OT-hPDE5N-009, OT-hPDE5N-010 showed an increase in PDE5-GFP protein levels with Sildenafil treatment when compared to DMSO treatment suggesting a Sildenafil dependent stabilization of the construct. Further, the hPDE5-GFP levels with DMSO treatment in OT-hPDE5N-002, OT-hPDE5N-003, and OT-hPDE5N-006 was lower than in the wildtype hPDE5 construct, OT-hPDE5N-001, indicating that these constructs are destabilized in the absence of ligand.

The GFP expression in cells expressing hPDE5 constructs was measured by FACS. HEK293 cells expressing OT-hPDE5N-001 to OT-hPDE5N-010 were incubated with 10M Sildenafil or vehicle control, DMSO for 48 hours and the mean fluorescence intensity (MFI) was calculated. The stabilization ratio was calculated as the fold change in GFP intensity in Sildenafil treated samples compared to treatment with DMSO (i.e. in the absence of ligand) with the same construct. The destabilizing mutation co-efficient was calculated as the fold change in GFP intensity in the hPDE5 mutant constructs (OT-hPDE5N-002 to OT-hPDE5N-010) compared to the hPDE5 wildtype construct (OT-hPDE5N-001) in the absence of the ligand. Destabilizing mutation co-efficient less than 1 and stabilization ratios greater than 1 are desired in DDs. The results and ratios are presented in Table 19.

TABLE 19

GFP expression in hPDE5 derived DDs

| Constructs | MFI DMSO | MFI Sildenafil | Stabilization ratio | Destabilizing mutation co-efficient |
|---|---|---|---|---|
| OT-hPDE5N-001 | 11064 | 25789 | 2.33 | |
| OT-hPDE5N-002 | 1649 | 12285 | 7.45 | 0.15 |
| OT-hPDE5N-003 | 1184 | 7303 | 6.17 | 0.11 |
| OT-hPDE5N-004 | 795 | 1065 | 1.34 | 0.07 |
| OT-hPDE5N-005 | 6924 | 29491 | 4.26 | 0.63 |
| OT-hPDE5N-006 | 1542 | 19211 | 12.46 | 0.14 |
| OT-hPDE5N-007 | 3038 | 7078 | 2.33 | 0.27 |
| OT-hPDE5N-008 | 1134 | 13189 | 11.63 | 0.10 |
| OT-hPDE5N-009 | 744 | 15587 | 20.95 | 0.07 |
| OT-hPDE5N-010 | 5053 | 21755 | 4.31 | 0.46 |

As shown in Table 19, all constructs demonstrated a stabilization ratio greater than one, indicating that all constructs show ligand (Sildenafil) dependent stabilization. The stabilization ratios of OT-hPDE5N-006, OT-hPDE5N-008, and OT-hPDE5N-009 was greater than 10 indicating strong ligand dependent stabilization. Constructs OT-hPDE5N-002, OT-hPDE5N-003, OT-hPDE5N-005, and OT-hPDE5N-010 showed stabilization ratio in the range of 2 to 10 indicating modest ligand dependent stabilization. The destabilizing mutation coefficient observed with all constructs was less than 1 indicating that all hPDE5 mutants are destabilized as compared to the wildtype hPDE5. Notably, constructs OT-hPDE5N-002, OT-hPDE5N-003, OT-hPDE5N-004, OT-hPDE5N-006, OT-hPDE5N-008, and OT-hPDE5N-009 demonstrated destabilizing mutation coefficients less than 0.2 indicating strong destabilizing in the absence of ligand. OT-hPDE5N-006, OT-hPDE5N-008, and OT-hPDE5N-009 were identified as mutants with desirable characteristics of a DD i.e., low basal expression in the absence of ligand and high expression in the presence of ligand.

Example 3. Sildenafil Dependent Stabilization of hPDE5 Mutants

HEK293 cells expressing OT-hPDE5N-006, OT-hPDE5N-008, or OT-hPDE5N-009 constructs were incubated with varying concentrations of Sildenafil ranging from 0.005 µM to 10 µM, or vehicle control (DMSO) for 48 hours. The stability of hPDE5 mutants was measured using FACS and mean fluorescence intensity (MFI) of GFP was calculated. The stabilization ratio was calculated as the fold change in GFP intensity in Sildenafil treated samples compared to treatment with DMSO (i.e. absence of ligand) with the same construct. Stabilization ratio greater than 1 is desired in DDs. The MFI and stabilization ratios are presented in Table 20.

TABLE 20

Sildenafil Dose titration

| Sildenafil dose (µM) | OT-hPDE5N-006 MFI | OT-hPDE5N-006 Stabilization ratio | OT-hPDE5N-008 MFI | OT-hPDE5N-008 Stabilization ratio | OT-hPDE5N-009 MFI | OT-hPDE5N-009 Stabilization ratio |
|---|---|---|---|---|---|---|
| Untreated | 7036 | | 4388 | | 3506 | |
| 0.0005 | 6848 | 0.97 | 4422 | 1.01 | 3513 | 1.00 |
| 0.0015 | 7239 | 1.03 | 4557 | 1.04 | 3473 | 0.99 |
| 0.0046 | 7218 | 1.03 | 4397 | 1.00 | 3539 | 1.01 |
| 0.0137 | 7127 | 1.01 | 4274 | 0.97 | 3683 | 1.05 |
| 0.041 | 8097 | 1.15 | 4395 | 1.00 | 4171 | 1.19 |
| 0.123 | 12248 | 1.74 | 4875 | 1.11 | 6463 | 1.84 |
| 0.37 | 22018 | 3.13 | 6753 | 1.54 | 13076 | 3.73 |
| 1.11 | 34171 | 4.86 | 10495 | 2.39 | 23468 | 6.69 |
| 3.33 | 49220 | 7.00 | 17960 | 4.09 | 34615 | 9.87 |
| 10 | 67084 | 9.53 | 32480 | 7.40 | 47793 | 13.63 |

As shown in Table 20, all three constructs showed an increase in stabilization ratio with increasing doses of Sildenafil indicating a ligand dose-dependent stabilization of hPDE5 mutants. The half maximal effective concentration or $EC_{50}$ was approximately 1 µM.

Sildenafil dependent stabilization of hPDE5 mutants was also measured over a period of time. HEK293 cells expressing OT-hPDE5N-006, OT-hPDE5N-008, and OT-hPDE5N-009 were treated with 10 µM of Sildenafil for 2, 4, 6, 16, 24, and 48 hours. The stability of hPDE5 mutants was measured using FACS and mean fluorescence intensity (MFI) of GFP was calculated. The stabilization ratio was calculated as the fold change in GFP intensity in Sildenafil treated samples compared to treatment with DMSO (i.e. absence of ligand) with the same construct. Stabilization ratio greater than 1 is desired in DDs. The MFI and stabilization ratios are presented in Table 21.

TABLE 21

Time course of Sildenafil treatment

| Time (h) | OT-hPDE5N-006 MFI | OT-hPDE5N-006 Stabilization ratio | OT-hPDE5N-008 MFI | OT-hPDE5N-008 Stabilization ratio | OT-hPDE5N-009 MFI | OT-hPDE5N-009 Stabilization ratio |
|---|---|---|---|---|---|---|
| Parental | 675 | — | 667 | — | 673 | — |
| 0 | 7921 | — | 5304 | — | 4195 | — |
| 2 | 12088 | 1.54 | 7290 | 1.37 | 6337 | 1.51 |
| 4 | 14046 | 1.77 | 8675 | 1.64 | 8159 | 1.95 |
| 6 | 16710 | 2.11 | 10929 | 2.06 | 10203 | 2.43 |
| 16 | 39029 | 4.93 | 19034 | 3.59 | 26279 | 6.26 |
| 24 | 51534 | 6.51 | 27246 | 5.14 | 36516 | 8.71 |
| 48 | 70811 | 8.94 | 34796 | 6.56 | 47407 | 11.30 |

As shown in Table 21, all three constructs showed an increase in stabilization ratio with increasing duration of treatment with Sildenafil indicating a time-dependent increase in stabilization of hPDE5 mutants.

Example 4. Vardenafil Dependent Stabilization of hPDE5 DDs

Vardenafil has an $IC_{50}$ of 0.7 nM and is a more potent inhibitor of hPDE5 than Sildenafil which has an $IC_{50}$ of 3.9 nM (Doggrell S, et al. (2007) Int J Impot. Res 19(3):281-95). To test if Vardenafil is capable of stabilizing hPDE5 DDs, HEK293 cells expressing OT-hPDE5-006, OT-hPDE5-008, and OT-hPDE5-009 were treated with Vardenafil at concentrations ranging from 0.0005 µM to 10 µM for 48 hours. The stability of hPDE5 mutants was measured using FACS and mean fluorescence intensity (MFI) of GFP was calculated. The stabilization ratio was calculated as the fold change in GFP intensity in Vardenafil treated samples compared to treatment with DMSO (i.e. absence of ligand) with the same construct. Stabilization ratio greater than 1 is desired in DDs. The MFI and stabilization ratios are presented in Table 22.

TABLE 22

Vardenafil Dose Titration

| Vardenafil dose (µM) | OT-hPDE5N-006 MFI | OT-hPDE5N-006 Stabilization ratio | OT-hPDE5N-008 MFI | OT-hPDE5N-008 Stabilization ratio | OT-hPDE5N-009 MFI | OT-hPDE5N-009 Stabilization ratio |
|---|---|---|---|---|---|---|
| Parental | 988 | — | 999 | — | 980 | — |
| 0 | 11287 | — | 7971 | — | 5841 | — |
| 0.0005 | 11770 | 1.04 | 7894 | 0.99 | 5954 | 1.02 |
| 0.0015 | 12965 | 1.15 | 8099 | 1.02 | 6601 | 1.13 |
| 0.0046 | 18739 | 1.66 | 8897 | 1.12 | 9946 | 1.70 |
| 0.0137 | 36940 | 3.27 | 12440 | 1.56 | 21894 | 3.75 |
| 0.041 | 58755 | 5.21 | 18527 | 2.32 | 39580 | 6.78 |
| 0.123 | 91994 | 8.15 | 33614 | 4.22 | 63622 | 10.89 |
| 0.37 | 125140 | 11.09 | 61010 | 7.65 | 86481 | 14.81 |
| 1.11 | 144927 | 12.84 | 95149 | 11.94 | 105930 | 18.14 |
| 3.33 | 172990 | 15.33 | 134306 | 16.85 | 123757 | 21.19 |
| 10 | 188068 | 16.66 | 166236 | 20.86 | 139165 | 23.83 |

As shown in Table 22, all three constructs showed an increase in stabilization ratio with increasing doses of Vardenafil indicating a Vardenafil dose-dependent stabilization of hPDE5 DDs. The half maximal effective concentration or $EC_{50}$ was approximately 0.1-0.3 µM which was less than the $EC_{50}$ observed with sildenafil (~1 µM) indicating that Vardenafil may stabilize hPDE5 DDs more potently than sildenafil.

The ability of Vardenafil to stabilize hPDE5 derived DDs was measured in cell lines stably transduced with hPDE5 DDs e.g. HEK293 cells, HCT-116 cells, and SKOV-3 cells. Cells were transduced with OT-hPDE5N-006, 008, and 009 constructs and incubated with 1 µM or 10 µM Vardenafil or with DMSO for 48 hours. The stability of hPDE5 mutants was measured using FACS and mean fluorescence intensity (MFI) of GFP was calculated. The stabilization ratio was calculated as the fold change in GFP intensity in Vardenafil treated samples compared to treatment with DMSO (i.e. absence of ligand) with the same construct. Stabilization ratio greater than 1 is desired in DDs. The MFI and stabilization ratios are presented in Table 23.

TABLE 23

Vardenafil Dose Titration

| Dose | OT-hPDE5N-006 (hPDE5- F736A) MFI | OT-hPDE5N-006 (hPDE5- F736A) Stabilization ratio | OT-hPDE5N-008 (hPDE5- Y728L) MFI | OT-hPDE5N-008 (hPDE5- Y728L) Stabilization ratio | OT-hPDE5N-009 (hPDE5- R732L) MFI | OT-hPDE5N-009 (hPDE5- R732L) Stabilization ratio |
|---|---|---|---|---|---|---|
| DMSO | 9604 | — | 5191 | — | 3605 | — |
| Vardenafil (1 µM) | 110603 | 11.52 | 68816 | 13.26 | 81484 | 22.60 |
| Vardenafil (10 µM) | 143351 | 14.93 | 123150 | 23.72 | 106403 | 29.52 |

As shown in Table 23, all three constructs showed an increase in stabilization ratio with both doses of Vardenafil indicating a ligand dose-dependent stabilization of hPDE5 DDs. These data are consistent with the results observed with the dose response of Vardenafil observed in Table 22.

Example 5. hPDE5 C Terminus Fusion Proteins

DDs may be positioned upstream or downstream of the payload within an SRE. hPDE5 mutants generated by site mutagenesis as discussed in example 2 are fused at the C-terminus of GFP to test if the hPDE5 mutants can destabilize proteins of interest when fused to the C-terminus of the protein of interest. A linker is placed between GFP and hPDE5 and cloned into pLVX.IRES. Puro. HEK 293T cells stably expressing GFP-hPDE5 (wildtype and mutant) constructs are incubated with 10 µM Sildenafil or 10 µM Vardenafil or DMSO (control) for 48 hours. Following the incubation, mean fluorescence intensity (MFI) is measured using FACS. All hPDE5 (mutant)-GFP constructs are expected to stabilize GFP in the presence of ligand while they are expected to destabilize GFP in the absence of ligand when fused to C terminus.

Example 6. Novel DDs Derived from Human hPDEs by Site Directed Mutagenesis

Known mutations in phosphodiesterases that affect protein stability are identified and utilized to identify novel hPDE derived DDs. Mutations previously identified include, but are not limited to, hPDE5 (I778T), or hPDE6C (H602L), hPDE6C (E790K), hPDE6C(R104W), hPDE6C (Y323N), and hPDE6C (P391L) or hPDE4D (S752A), hPDE4D (S754A), hPDE4D (S752A, S754A), and hPDE4D (E757A, E758A, D759A) (Zhu et al. (2010) Mol Cell Biol. 4379-4390; Alexandre et al. (2015). Endocr. Relat. Cancer 22(4): 519-30; Cheguru P. et al. (2015) Mol Cell Neurosci; 64: 1-8; the contents of each of which are incorporated herein by reference in their entirety). Human PDE mutants are fused to a linker, and a reporter gene e.g. GFP. The reporter constructs are transfected into cells such as NIH 3T3 cells and 293T cells. Transfected cells are incubated with appropriate ligand e.g. Sildenafil and Vardenafil for hPDE5 or Apremilast and Roflumilast for hPDE4. Fluorescence signal is measured by FACS and mean fluorescence signal intensity is calculated.

Example 7. Characterization of hPDE5 Mutants Using Thermal Shift Assays

Thermal shift assays can be used to measure the thermal denaturation temperature of a protein as an indicator of its stability in response to different conditions such as pH, ions, salts, additives, drugs, and/or mutations. Additionally, thermal shift assays can be used to understand the correlation between ligand binding, enzymatic activity and stabilization potencies. Human PDE5 mutants are mixed with a thermal assay dye, thermal assay buffer, and ligand (or DMSO control). Samples are also treated with varying concentrations of factors such as drugs, salts, ions, or other parameters. The samples are loaded into an instrument such as a real-time PCR instrument and the temperature ramp rates is set within a range of approximately 0.1-10 degrees Celsius per minute. The fluorescence in each condition is measured at regular intervals, over a temperature range spanning the typical protein unfolding temperatures of 25-95 degrees Celsius.

Example 8. Characterization of hPDE5 Truncation Mutants

The data shown in the previous examples show that the catalytic domain of hPDE5 was a suitable template for the identification of destabilizing domains. Several truncation mutants of the full length hPDE5 were generated to identify regions beyond the catalytic within the catalytic domain that may serve as a template for identifying DDs. The truncation mutants tested included amino acids 535-860 of hPDE5 WT (E535-Q860), amino acids 535 to 836 of hPDE5 WT (E535-S836), amino acids 590 to 860 of hPDE5 WT (M590-Q860), amino acids 590 to 836 of hPDE5 WT (M590-S836), wherein the amino acids positions are with respect to SEQ ID NO.1. The DD mutation R732L was incorporated into all truncation mutants and its destabilizing potential was compared to E535-Q860 wildtype by fusing the mutants to an SG linker and reporter, AcGFP. HCT-116 cells were stably transduced with the constructs described above and treated with 10 µM stabilizing ligands, Sildenafil, or Vardenafil or DMSO for 48 hours. As a control, parental untransduced cells and cells expressing OT-hPDE5N-001, or OT-hPDE5N-028 were also included in the analysis. The mean fluorescence intensity (MFI) of GFP was analyzed by FACS. The stabilization ratio was calculated as the fold change in GFP intensity in Sildenafil treated samples compared to treatment with DMSO (i.e. in the absence of ligand) with the same construct. The destabilizing mutation coefficient was calculated as the fold change in GFP intensity in the hPDE5 mutant constructs compared to the hPDE5 wildtype construct (OT-hPDE5N-019) in the absence of the ligand. Destabilizing mutation coefficients less than 1 are desirable. Stabilization ratios greater than 1 are desired in DDs. The results and ratios are presented in Table 24.

TABLE 24

Expression of hPDE5 truncation mutants

| Construct | MFI DMSO | MFI Sildenafil | MFI Vardenafil | Sildenafil Stabilization ratio | Vardenafil Stabilization ratio | Destabilizing mutation coefficient |
|---|---|---|---|---|---|---|
| Parental | 2093 | 3735 | 3200 | 1.78 | 1.53 | — |
| OT-hPDE5N-001 | 42973 | 53736 | 49344 | 1.25 | 1.15 | — |
| OT-hPDE5N-028 | 150356 | 187845 | 170129 | 1.25 | 1.13 | — |
| OT-hPDE5N-019 | 64942 | 66860 | 67388 | 1.03 | 1.04 | — |
| OT-hPDE5N-020 | 9248 | 55636 | 93216 | 6.02 | 10.08 | 0.14 |
| OT-hPDE5N-021 | 4542 | 4608 | 5188 | 1.01 | 1.14 | 0.07 |
| OT-hPDE5N-022 | 3395 | 3434 | 3523 | 1.01 | 1.04 | 0.05 |

TABLE 24-continued

Expression of hPDE5 truncation mutants

| Construct | MFI | | | Sildenafil Stabilization ratio | Vardenafil Stabilization ratio | Destabilizing mutation coefficient |
|---|---|---|---|---|---|---|
| | DMSO | Sildenafil | Vardenafil | | | |
| OT-hPDE5N-023 | 2689 | 2686 | 2660 | 1.00 | 0.99 | 0.04 |
| OT-hPDE5N-024 | 2809 | 2663 | 2770 | 0.95 | 0.99 | 0.04 |

As shown in Table 24, OT-hPDE5N-020 construct consisting of E535-Q860 amino acids of hPDE5 with the R732L mutant displayed the strongest ligand dependent stabilization with both ligands with the highest stabilization ratio. The destabilizing mutation coefficient was also calculated for constructs 020-024 and this analysis showed that the constructs were all effective in destabilizing the payload. This suggests that the removal of residues from the catalytic domain does not appear to enhance the ligand dependent stabilization potential of hPDE5.

Protein expression analysis of the truncation mutants was performed in parallel via western blot. HCT 116 cells expressing OT-hPDE5N-019 to OT-hPDE5N-024 were treated with 10 µM Vardenafil for 24 hours and immunoblotted for AcGFP using anti AcGFP antibodies (catalog no. 63277, Clonetech, Mountain View, Calif.). GAPDH levels were also analyzed to ensure even protein loading. OT-hPDE5N-020 construct consisting of E535-Q860 i.e. amino acids 535 to 860 of hPDE5 WT (SEQ ID NO.1) with the R732L mutant showed vardenafil dependent stabilization. This result is consistent with the FACS analysis. Stabilization was not observed with OT-hPDE5N-021, while constructs OT-hPDE5N-022, OT-hPDE5N-023, and OT-hPDE5N-024 showed no AcGFP expression, both in the presence and absence of vardenafil, indicating that the expression of the construct in these mutants is below the detection levels of the western blot method.

Example 9. Characterization of hPDE5 Combination Mutants

Single destabilizing mutants identified were combined to test if the combining two or more mutations generates domains with greater destabilizing potential either additively or synergistically. Desirable qualities of a DD include, low expression of the SRE in the absence of ligand and ligand dependent stabilization of the SRE. Constructs were generated using DDs linked to GFP using an SG linker. HCT-116 cells were stably transduced with the constructs described above and treated with 10 µM stabilizing ligands, Sildenafil, or Vardenafil or DMSO for 48 hours. As a control, parental untransduced cells and cells expressing OT-hPDE5N-001, or OT-hPDE5N-028 were also included in the analysis. The mean fluorescence intensity (MFI) of GFP was analyzed by FACS. The stabilization ratio was calculated as the fold change in GFP intensity in Sildenafil treated samples compared to treatment with DMSO (i.e. in the absence of ligand) with the same construct. The destabilizing mutation coefficient was calculated as the fold change in GFP intensity in the hPDE5 mutant constructs compared to the hPDE5 wildtype construct (OT-hPDE5N-019) in the absence of the ligand. Destabilizing mutation coefficient less than 1 are desirable. Stabilization ratios greater than 1 are desired in DDs. The results and ratios are presented in Table 25.

TABLE 25

Expression of hPDE5 combination mutants

| Construct | MFI | | | Sildenafil Stabilization ratio | Vardenafil Stabilization ratio | Destabilizing mutation coefficient |
|---|---|---|---|---|---|---|
| | DMSO | Sildenafil | Vardenafil | | | |
| Parental | 2093 | 3735 | 3200 | 1.78 | 1.53 | — |
| OT-hPDE5N-001 | 42973 | 53736 | 49344 | 1.25 | 1.15 | — |
| OT-hPDE5N-028 | 150356 | 187845 | 170129 | 1.25 | 1.13 | — |
| OT-hPDE5N-019 | 64942 | 66860 | 67388 | 1.03 | 1.04 | — |
| OT-hPDE5N-025 | 12633 | 13862 | 53848 | 1.10 | 4.26 | 0.19 |
| OT-hPDE5N-026 | 8625 | 48592 | 109667 | 5.63 | 12.72 | 0.13 |

As shown in Table 25, only the OT-hPDE5N-026 construct with R732L and D764N mutations showed Sildenafil dependent stabilization with a ratio of 5.63. Similar results were obtained with OT-hPDE5N-026 upon treatment with Vardenafil. OT-hPDE5N-025 however only showed Vardenafil dependent stabilization with a ratio of 4.26. Both constructs were destabilized in the absence of ligand. As expected, hPDE5 wildtype constructs did not show any significant ligand dependent stabilization. These data suggest that the strategy of combining mutations may be used to identify improved DDs as well as DDs that are stabilized by specific ligands.

Protein expression analysis of the combination mutants was performed in parallel via western blot. HCT 116 cells expressing OT-hPDE5N-025, and 26 were treated with 10 µM Vardenafil for 24 hours and immunoblotted for AcGFP using anti AcGFP antibodies (catalog no. 63277, Clonetech, Mountain View, Calif.). GAPDH levels were also analyzed to ensure even protein loading. OT-hPDE5N-025 with hPDE5 (F736A, D764N) and OT-hPDE5N-026 with hPDE5

(R732L, D764N) constructs consisting showed Vardenafil dependent stabilization of AcGFP protein levels as measured via western blotting. This result is consistent with the FACS analysis.

The response of hPDE5 combination mutants to increasing doses of sildenafil was tested. HCT116 cells transduced with hPDE5 constructs were treated with Sildenafil for 24 hours at doses ranging from 0.04 µM to 30 µM. Mean fluorescence intensity (MFI) was measured by FACS. Parental HCT116 and cells expressing OT-hPDE5N-019 wildtype construct were also included as controls. The response of the combination mutants to Sildenafil was compared to the response of the single mutant construct OT-hPDE5N-020. The stabilization ratio indicated as SR in Table 26 was calculated as the fold change in GFP intensity in Sildenafil treated samples compared to treatment with DMSO (i.e. in the absence of ligand) with the same construct. The destabilizing mutation coefficient ratio was calculated as the fold change in GFP intensity in the hPDE5 mutant constructs compared to the hPDE5 wildtype construct (OT-hPDE5N-019) in the absence of the ligand. Destabilizing mutation coefficient ratios less than 1 are desirable. Stabilization ratios greater than 1 are desired in DDs. The results and stabilization ratios are presented in Table 26.

co-efficient ratios obtained for the OT-hPDE5N-020 (ratio=0.1), OT-hPDE5N-025 (ratio=0.17), and OT-hPDE5N-026 (ratio=0.1) indicate that all constructs are destabilized in the absence of the ligand. These data indicate that the combination mutant OT-hPDE5N-026 is strong DD candidate when the stabilizing ligand is Sildenafil.

The response of hPDE5 combination mutants to increasing doses of Vardenafil was tested. HCT116 cells transduced with hPDE5 constructs were treated with Vardenafil for 24 hours at doses ranging from 0.04 µM to 30 µM. Mean fluorescence intensity (MFI) was measured by FACS. Parental HCT116 and cells expressing OT-hPDE5N-019 comprising hPDE5 wildtype construct were also included as controls. The response of the combination mutants to Vardenafil was compared to the response of the single mutant construct OT-hPDE5N-020. The stabilization ratio (SR) was calculated as the fold change in GFP intensity in Vardenafil treated samples compared to treatment with DMSO (i.e. in the absence of ligand) with the same construct. The destabilizing mutation coefficient ratio was calculated as the fold

TABLE 26

Sildenafil dose response of combination mutants

| Dose (µM Sildenafil) | OT-hPDE5N-019 MFI | SR | OT-hPDE5N-020 MFI | SR | OT-hPDE5N-025 MFI | SR | OT-hPDE5N-026 MFI | SR |
|---|---|---|---|---|---|---|---|---|
| DMSO | 62116 | — | 6172 | — | 10736 | — | 7093 | — |
| 30 | 75478 | 1.22 | 47992 | 7.78 | 26837 | 2.50 | 69864 | 9.85 |
| 10 | — | — | 27693 | 4.49 | 13263 | 1.24 | 34587 | 4.88 |
| 3.33 | — | — | 23549 | 3.82 | 10384 | 0.97 | 22392 | 3.16 |
| 1.11 | — | — | 15952 | 2.58 | 9636 | 0.90 | 10353 | 1.46 |
| 0.37 | — | — | 12739 | 2.06 | 9802 | 0.91 | 6961 | 0.98 |
| 0.12 | — | — | 6441 | 1.04 | 8619 | 0.80 | 6603 | 0.93 |
| 0.04 | — | — | 5299 | 0.86 | 8688 | 0.81 | 5948 | 0.84 |

As shown in Table 26, the stabilization ratios for OT-hPDE5N-026 construct obtained across multiple doses of sildenafil were higher than the single mutant OT-hPDE5N-020 construct. The combination mutant 025, achieved stabilization ratios much lower than the 026 construct for any given ligand dose. The destabilizing mutation change in GFP intensity in the hPDE5 mutant constructs compared to the hPDE5 wildtype construct (OT-hPDE5N-019) in the absence of the ligand. Destabilizing mutation co-efficient ratios less than 1 are desirable. Stabilization ratios greater than 1 are desired in DDs. The results and stabilization ratios are presented in Table 27.

TABLE 27

Vardenafil dose response of combination mutants

| Dose (µM Vardenafil) | OT-hPDE5N-019 MFI | SR | OT-hPDE5N-020 MFI | SR | OT-hPDE5N-025 MFI | SR | OT-hPDE5N-026 MFI | SE |
|---|---|---|---|---|---|---|---|---|
| DMSO | 62116 | — | 7829 | — | 7694 | — | 5156 | |
| 30 | 70898 | 1.14 | 75323 | 9.62 | 46109 | 5.99 | 55843 | 10.83 |
| 10 | — | — | 39089 | 4.99 | 29971 | 3.90 | 35191 | 6.83 |
| 3.33 | — | — | 35564 | 4.54 | 29520 | 3.84 | 40408 | 7.84 |
| 1.11 | — | — | 30879 | 3.94 | 12634 | 1.64 | 32868 | 6.37 |
| 0.37 | — | — | 24847 | 3.17 | 6667 | 0.87 | 14543 | 2.82 |
| 0.12 | — | — | 16866 | 2.15 | 7314 | 0.95 | 10676 | 2.07 |
| 0.04 | — | — | 14745 | 1.88 | 6174 | 0.80 | 5497 | 1.07 |

As shown in Table 27, the stabilization ratios for OT-hPDE5N-026 construct obtained across multiple doses of Vardenafil were higher than the single mutant OT-hPDE5N-020 construct. The combination mutant 025, achieved stabilization ratios much lower than the 026 construct for any given ligand dose. The destabilizing mutation coefficient obtained for the OT-hPDE5N-020 (ratio=0.13), OT-hPDE5N-025 (ratio=0.12), and OT-hPDE5N-026 (ratio=0.08) indicate that all constructs are destabilized in the absence of the ligand. These data indicate that the combination mutant OT-hPDE5N-026 is strong DD candidate when the stabilizing ligand is Vardenafil.

The response of hPDE5 combination mutants to increasing doses of Tadalafil was tested. HCT116 cells transduced with hPDE5 constructs were treated with Tadalafil for 24 hours at doses ranging from 0.14 to 100 µM. Mean fluorescence intensity (MFI) was measured by FACS. Parental HCT116 and cells expressing OT-hPDE5N-019 comprising hPDE5 wildtype construct were also included as controls. The response of the combination mutants to Tadalafil was compared to the response of the single mutant construct OT-hPDE5N-020. The stabilization ratio (SR) was calculated as the fold change in GFP intensity in Tadalafil treated samples compared to treatment with DMSO (i.e. in the absence of ligand) with the same construct. The destabilizing mutation coefficient was calculated as the fold change in GFP intensity in the hPDE5 mutant constructs compared to the hPDE5 wildtype construct (OT-hPDE5N-0019) in the absence of the ligand. Destabilizing mutation coefficient less than 1 are desirable. Stabilization ratios greater than 1 are desired in DDs. The results and stabilization ratios are presented in Table 28.

TABLE 28

Tadalafil dose response of combination mutants

| Dose (µM) Vardenafil) | OT-hPDE5N-019 | | OT-hPDE5N-020 | | OT-hPDE5N-025 | | OT-hPDE5N-026 | |
|---|---|---|---|---|---|---|---|---|
| | MFI | SR | MFI | SR | MFI | SR | MFI | SR |
| DMSO | 36453 | — | 3806 | — | 6043 | — | 3746 | — |
| 100 | 58468 | 1.60 | 34041 | 8.94 | 23542 | 3.90 | 30029 | 8.02 |
| 33.33 | — | — | 44713 | 11.75 | 20464 | 3.39 | 30028 | 8.02 |
| 11.11 | — | — | 30641 | 8.05 | 13789 | 2.28 | 24499 | 6.54 |
| 3.7 | — | — | 26480 | 6.96 | 9515 | 1.57 | 17317 | 4.62 |
| 1.23 | — | — | 20458 | 5.38 | 8634 | 1.43 | 9283 | 2.48 |
| 0.41 | — | — | 13206 | 3.47 | 6141 | 1.02 | 6044 | 1.61 |
| 0.14 | — | — | 8512 | 2.24 | 5768 | 0.95 | 4682 | 1.25 |

As shown in Table 28, the stabilization ratios for OT-hPDE5N-026 construct obtained across multiple doses of Tadalafil were higher than the single mutant OT-hPDE5N-020 construct, except at the 100 µM concentration of the drug. The combination mutant OT-hPDE5-025, achieved stabilization ratios much lower than the OT-hPDE5-026 construct for any given ligand dose. The destabilizing mutation coefficient obtained for the OT-hPDE5N-020 (ratio=0.1), OT-hPDE5N-025 (ratio=0.17), and OT-hPDE5N-026 (ratio=0.1) indicate that all constructs are destabilized in the absence of the ligand. These data indicate that the combination mutant OT-hPDE5N-026 is strong DD candidate when the stabilizing ligand is Tadalafil.

The stabilization ratios obtained for the highest concentrations of all three ligands, Sildenafil, Vardenafil and Tadalafil for each of the constructs were compared and are shown Table 29.

TABLE 29

Comparative analysis of hPDE5 ligands

| | Stabilization ratio | | | |
|---|---|---|---|---|
| Ligand | OT-hPDE5N-019 | OT-hPDE5N-020 | OT-hPDE5N-025 | OT-hPDE5N-026 |
| Sildenafil (30 µM) | 1.22 | 7.78 | 2.5 | 9.85 |
| Vardenafil (30 µM) | 1.14 | 9.62 | 5.99 | 10.83 |
| Tadalafil (100 µM) | 1.60 | 8.94 | 3.9 | 8.02 |

As shown in Table 29, based on the stabilization ratios it was evident that OT-hPDE5N-026 was effectively stabilized by all three ligands, in comparison to both the single mutant construct as well as the other combination mutant construct (OT-hPDE5N-025). Both combination mutants were most effectively stabilized by Vardenafil, which is the most potent inhibitor of hPDE5. Construct OT-hPDE5N-025 was stabilized more effectively by Tadalafil than Sildenafil, although only by a small margin—this observation is noteworthy as Sildenafil is a much stronger inhibitor of hPDE5 than Tadalafil The response of hPDE5 combination mutants to increasing duration treatment with sildenafil was tested. HCT116 cells transduced with hPDE5 constructs were treated with Sildenafil at 0.5 or 5 µM for 0-72 hours. Mean fluorescence intensity (MFI) was measured by FACS. The response of the combination mutants to Sildenafil was compared to the response of the single mutant construct OT-hPDE5-020. The stabilization ratio was calculated as the fold change in GFP intensity in Sildenafil treated samples compared to treatment with DMSO (i.e. in the absence of ligand) with the same construct. The destabilizing mutation coefficient was calculated as the fold change in GFP intensity in the hPDE5 mutant constructs compared to the hPDE5 wildtype construct (OT-hPDE5N-019) in the absence of the ligand. Destabilizing mutation coefficient less than 1 are desirable. Stabilization ratios greater than 1 are desired in DDs. The results and stabilization ratios for time course experiments with 5 or 0.5 µM are presented in Table 30 and Table 31 respectively.

TABLE 30

Response to Sildenafil (5 µM) over time

| Time (hours) | OT-hPDE5N-020 MFI | OT-hPDE5N-020 Stabilization ratio | OT-hPDE5N-025 MFI | OT-hPDE5N-025 Stabilization ratio | OT-hPDE5N-026 MFI | OT-hPDE5N-026 Stabilization ratio |
|---|---|---|---|---|---|---|
| 0  | 2668  | —     | 3364  | —    | 2769  | —     |
| 72 | 58479 | 21.92 | 26995 | 8.02 | 90413 | 32.65 |
| 48 | 46604 | 17.47 | 22061 | 6.56 | 65233 | 23.56 |
| 24 | 20955 | 7.85  | 16705 | 4.97 | 27962 | 10.10 |
| 20 | 15529 | 5.82  | 13280 | 3.95 | 21603 | 7.80  |
| 16 | 14855 | 5.57  | 12280 | 3.65 | 17600 | 6.36  |
| 12 | 9097  | 3.41  | 9199  | 2.73 | 10451 | 3.77  |
| 8  | 5672  | 2.13  | 7021  | 2.09 | 6179  | 2.23  |
| 4  | 4236  | 1.59  | 6314  | 1.88 | 4266  | 1.54  |

TABLE 31

Response to Sildenafil (0.5 µM) over time

| Time (hours) | OT-hPDE5N-020 MFI | OT-hPDE5N-020 Stabilization ratio | OT-hPDE5N-025 MFI | OT-hPDE5N-025 Stabilization ratio | OT-hPDE5N-026 MFI | OT-hPDE5N-026 Stabilization ratio |
|---|---|---|---|---|---|---|
| 0  | 2727  | —     | 3245 | —    | 2611  | —     |
| 72 | 58786 | 21.56 | 6906 | 2.13 | 31835 | 12.19 |
| 48 | 45754 | 16.78 | 6682 | 2.06 | 27231 | 10.43 |
| 24 | 20524 | 7.53  | 6144 | 1.89 | 17848 | 6.84  |
| 20 | 16142 | 5.92  | 6003 | 1.85 | 13318 | 5.10  |
| 16 | 14469 | 5.31  | 5600 | 1.73 | 11390 | 4.36  |
| 12 | 9058  | 3.32  | 5122 | 1.58 | 8126  | 3.11  |
| 8  | 5461  | 2.00  | 5083 | 1.57 | 5742  | 2.20  |
| 4  | 4127  | 1.51  | 5322 | 1.64 | 3870  | 1.48  |

As shown in Table 30 and Table 31, the stabilization ratios for OT-hPDE5N-026 construct obtained over time at 5 µM dose of Sildenafil were higher than the single mutant OT-hPDE5N-020 construct. However, this pattern was reversed at lower dose of 0.5 µM where the single mutant construct showed greater stabilization. The combination mutant OT-hPDE5-025, achieved stabilization ratios much lower than the OT-hPDE5-026 construct for both ligand doses at any given time. These data indicate that the choice of a suitable DD may sometime depend on the duration of the ligand treatment desired as well as the concentration of the ligand that is available for use in a system.

Example 10. Mutagenesis of DD Hotspots

The analysis of mutants identified by site directed mutagenesis identified amino acid hotspots whose mutation confers destabilization and ligand dependent stabilization properties to hPDE5. To improve the DD characteristics of these constructs, the amino acid at the hotspot position is mutated to any of the known amino acids, including, but not limited to lysine, aspartic acid, glutamic acid, glutamine, asparagine, histidine, serine, threonine, tyrosine, cysteine, methionine, tryptophan, alanine, isoleucine, leucine, phenylalanine, valine, proline, and glycine. The library of hotspot mutations is generated by site directed mutagenesis and each of the mutants in the library is fused to a reporter protein e.g. AcGFP via a linker. The properties of the DDs are analyzed in the presence and absence of ligands via western blot and FACS as previously described. Ligands that are evaluated include, but not limited Sildenafil, Vardenafil and Tadalafil.

Example 11. Optimizing Biocircuit Behavior

The biocircuits of the invention comprises multiple modules which can be optimized. Libraries of each of the components is generated to allow for the rapid generation of new constructs with desired behaviors. Ligand pharmacokinetics is a powerful tool for payload specific tuning in vivo, which can be used to shift the ligand response curve of the effector module to the left or right depending on the modulating factors. Several modulating factors are tested, including, but not limited to the ligand dose, concentrations, magnitude, duration, and route of administration. Destabilizing domains can also be modified to improve biocircuit behavior. The destabilizing domain is the core determinant of the dynamic range of the biocircuit. Depending on the DD selected, the ligand response curve of the effector module can be shifted up or down. The nature, position of the DD within the effector module as well as the number of DDs within an effector module are modified. DD selection is also altered depending on its degradation kinetics desired. Promoters that transcriptionally control the expression of the SREs are optimized. Choice of promoter impacts the basal-off state and affects the dynamic range of stabilization. Further, promoter choice contributes to the extent of stabilized payload produced. Other optimizable elements of the biocircuits include vector, translational elements, leader sequence, placement of the components within the SRE, codon selection, protease sites, linkers, and mRNA stability.

Example 12. Vardenafil Dose Response Curve in hPDE5 Mutants

Combination mutants were generated as described in Example 9. The response of hPDE5 combination mutants to increasing doses of Vardenafil was tested in HCT116 cells transduced with hPDE5 constructs were treated with Vardenafil for 48 hours at doses ranging from 0.1 to 10 µM or vehicle control (DMSO). Mean fluorescence intensity (MFI) of GFP was measured by FACS. The response of the combination mutants to Vardenafil was compared to the response of the single mutant construct OT-hPDE5N-020. The fold change in MFI over DMSO is presented in Table 32.

TABLE 32

Vardenafil dose response

| Sildenafil (µM) | OT-hPDE5-020 | OT-hPDE5-025 | OT-hPDE5-026 |
|---|---|---|---|
| 0.01 | 4026 | 4444 | 3815 |
| 0.04 | 6970 | 4934 | 3839 |
| 0.12 | 14832 | 5133 | 4870 |
| 0.37 | 26429 | 5007 | 8107 |
| 1.11 | 34932 | 5751 | 21857 |
| 3.33 | 49739 | 10516 | 49105 |
| 10.00 | 51306 | 24927 | 64734 |

As shown in Table 32, the ligand dependent stabilization obtained for OT-hPDE5N-020 construct was observed at lower doses i.e. 0.1 and 0.3 micro molar concentrations of Vardenafil compared to the other two constructs, indicating that very low doses of the ligand are sufficient to stabilize this hPDE5 mutant. The OT-hPDE5N-026 construct did not show ligand dependent stabilization at similar doses. However, at the highest dose of Vardenafil the GFP expression obtained was much higher than OT-hPDE5N-020. In contrast, OT-hPDE5N-025 showed very little expression of GFP at lower doses and only modest GFP expression compared to the other two constructs at the higher doses. These experiments indicate that combination of single hPDE5 DD mutations produces synergistic effects not predicted by the properties of the single mutants. Thus, based on the properties of the payload of interest and the expression levels desired, suitable hPDE5 DDs may be selected.

Example 13. DD Regulated Immunotherapeutic Agent Expression In Vitro

Immunotherapeutic payloads of the invention such as cytokines (e.g. IL2, IL12, IL15, IL15-IL15Ra), chimeric antigen receptors (CD19 CAR), regulatory proteins (e.g. FOXP3), safety switch (e.g. Caspase 9) are fused to any of the DDs described herein and cloned into expression vectors. Optional linkers and cleavage sites are added to optimize the confirmation of the effector module.

To test ligand dependent immunotherapeutic payload production, cells are plated in a growth media e.g. DMEM with 10% FBS and incubated overnight at 37° C., 5% CO2. Cells are transiently transfected or transduced with the constructs using Lipofectamine 2000 and incubated for 48 hrs. Following the incubation, growth media is exchanged for media containing ligands (e.g. Sildenafil, Vardenafil, and Tadalafil). Following 24-hour incubation with ligand, cells are lysed and immunoblotted using antibodies specific to the payload. For secreted payloads, such as cytokines, the growth media is harvested from the cultures expressing the effector modules of the present invention. Similar to the immunoblot, the media is assayed for the expression of the payload using methods known in the art such as ELISA and MSD assay. For cell surface expressed payloads, the expression of the payload is also assayed using methods of cell surface expression analysis that are known in the art such as flow cytometry. Expression of the payload obtained in the presence of ligand is compared to expression in the absence of ligand. Increase in the levels of the payload with increase in ligand concentrations and/or duration of treatment is indicative of DD mediated regulation of the payload. Expression is also compared to parental untransduced cells as well as cells expressing immunotherapeutic payloads that are not appended to DD (i.e. expressed constitutively).

Example 14. DD Regulated Immunotherapeutic Agent Function In Vitro

To test if DD regulated IL12's expression is capable of activating IL12 signaling. Human T-cells are isolated from PBMCs and activated with phytohemagglutinin (PHA, 2 g/ml) for 3 days, followed by treatment with 50 IU/ml of Interleukin-2 (IL2) for 24 hrs. Cells are washed, resuspended in fresh media and rested for 4 hrs. T cells are transduced with DD-regulated IL12 constructs and treated with the ligand (e.g. Sildenafil, Vardenafil, and Tadalafil) based on the DD utilized or the vehicle control. Activation via IL12 results in STAT4 phosphorylation. Additionally, IL12 promotes the differentiation of naïve T cells into Th1 cells, which results in the secretion of IFN gamma from T cells. Cells are harvested and STAT4 phosphorylation is measured using STAT4 antibody (Cell Signaling Technology, Danvers, Mass.). Cell supernatants and cell lysates are analyzed for IFNgamma. In the presence of ligand, cells expressing DD regulated IL12 are expected to have increased STAT4 phosphorylation and increased expression of IFNgamma.

IL15 and IL15/IL15Ra fusion molecule can confer the memory phenotype on T cells and increase proliferation of NK cells (Hurton L et al. (2016), PNAS, 113: E7788-7797). This dependence of NK cell proliferation on cytokines can be used to test the functionality of DD regulated or constitutively expressed cytokines and cytokine fusion proteins. NK-92 cell activation in response to ligand treatment is evaluated by FACS using a panel of markers whose increased expression is associated with NK activation. These include NKG2D, CD71, CD69; chemokine receptors such as CCR5, CXCR4, and CXCR3, Perforin, Granzyme B and Interferon gamma (IFNg). Expression of DD regulated IL15 or IL15-IL15Ra fusion molecules is expected to increase NK cell activation. To evaluate the effect by ligand-dependent stabilization of IL15 and IL15-IL15Ra on primary T cells, T cells are transduced with DD-IL15Ra constructs. T cell proliferation and memory phenotype markers (e.g. CD62L) are measured either in the presence or absence of ligand by using flow cytometry.

To test the ability of DD regulated CD19 CAR cells to kill target cells in vitro, primary T cell populations are transduced with DD regulated CD19 CAR constructs are co cultured with K562 cells expressing CD19 (target cells) in the presence or absence of the ligand specific to the DD. Multiple combinations of T cells and target cells are set up. These include DD regulated CAR expressing T cells co cultured with K562 cells (in the presence or absence of the ligand), T cells co cultured with K562 cells expressing CD19 and K562 cells expressing CD19 without T cell co culture. Additional controls include target cells only; untransduced T cells; T cells transduced with empty vector. Target cells are treated with Mitomycin C to prevent their proliferation. The K562 cells are fluorescently labelled with NucLight Red and co cultured with T cells for 300 hours. Cell death is monitored by labelling cells with Annexin V and the cell death in target K562 cells is monitored by evaluating cells that are positive for both Annexin V and NucLight Red using the IncuCyte® Live Cell Analysis System (Essen Biosciences, Ann Arbor, Mich.). Target cell killing is expected with the DD regulated CAR constructs only in the presence of ligand and when K562 target cells ectopically expressing CD19 are utilized. No cell killing is expected in untreated controls of the same co-culture set up and when T cells are co cultured with parental K562 cells that do not express CD19 in the presence or absence of ligand. Constitutive constructs are predicted to show cell killing both in the presence of ligand.

Example 15. DD Regulated Immunotherapeutic Agent Function In Vivo

The ligand-dependent in vivo function of DD-regulated immunotherapeutic payloads is characterized by evaluating the ability of T cells expressing DD regulated constructs to inhibit the growth of established tumors upon treatment with the ligands of the invention. Tumor cells such as HCT116 cells are subcutaneously xenografted into mice. T cells stably transduced with a DD regulated constructs described herein are injected intravenously into mice. Approximately, two weeks after injection when the tumors reach a size of approximately 300 cubic mm, mice are dosed with the ligand (e.g. Sildenafil, Vardenafil, and Tadalafil) or vehicle control at varying concentrations every two days. Tumor volume and body weight are monitored twice a week. Plasma and tumor samples are also collected after the last dosing of the ligand and the payload levels as well as the ligand levels are measured. Tumor volume is expected to be significantly smaller in mice treated the ligand compared to vehicle treated animals. Tumor payload levels are expected to positively correlate with tumor volume.

To measure if compositions of the invention promote immune cell persistence, T cells transduced with DD-IL15/IL15Ra constructs are injected into mice. Mice are treated with the ligand (e.g. Sildenafil, Vardenafil, and Tadalafil) and monitored over a period of 40-50 days. T cells transduced with a constitutive OT-IL15-008 construct and untransduced parental T cells are injected into separate mice as controls. Blood is routinely withdrawn from the mice and tested for the presence of T cells. Mice treated with the ligand are expected to retain T cells expressing hPDE5 DD-IL15-IL15Ra while T cells in vehicle treated mice are not expected to persist.

Example 16. Co-Expression of DD Regulated Payloads

Toxicity related to systemic administration of interleukins can be circumvented by using CAR-T cells to deliver interleukins to the target tissue. This combinatorial approach also has greater anti-tumor activity than interleukin and CAR therapy alone. Cells are co-transfected with CD19 CAR (constitutive or DD regulated) and DD-Interleukin e.g. DD-IL2, DD-IL12, DD-IL15 and DD-IL15/IL15Ra constructs. Transfected cells are treated with stabilizing ligands depending on the DD utilized. CD19 CAR expression is evaluated by immunoblotting for CD3 zeta. DD-IL2, DD-IL12, DD-IL15 and DD-IL15/IL15Ra expression in the media is measured by ELISA.

A DD-regulated caspase 9 has the potential improve safety and minimize the toxicity associated with CD19 CAR therapy. Cells are co-transfected with CD19 CAR (constitutive or DD regulated) and DD-caspase 9 constructs. Transfected cells are treated with stabilizing ligands depending on the DD utilized. CD19 CAR and caspase 9 expression are evaluated by immunoblotting for CD3 zeta and caspase 9 respectively.

Example 17. Sildenafil and Tadalafil Dose Response Curve in hPDE5 Mutants

Combination mutations were generated as previously described in Example 9. The response of HCT 116 cells expressing hPDE5 combination mutants to increasing doses ranging from 0.1 μM to 100 μM of Tadalafil and Sildenafil for 48 hours or vehicle control (DMSO) was tested. Mean fluorescence intensity (MFI) was measured by FACS. The response of the combination mutants to ligand treatment was compared to the single mutant construct, OT-hPDE5N-020. The MFI with ligand treatment is shown in Table 33 and Table 34.

TABLE 33

Tadalafil dose response

| Tadalafil (μM) | OT-hPDE5-020 | OT-hPDE5-025 | OT-hPDE5-026 |
|---|---|---|---|
| 0.14 | 3616 | 4328 | 3720 |
| 0.41 | 5811 | 5002 | 3804 |
| 1.23 | 11694 | 5503 | 4810 |
| 3.70 | 24185 | 5744 | 7893 |
| 11.11 | 40380 | 8299 | 24617 |
| 33.33 | 57233 | 15831 | 52927 |
| 100.00 | 72587 | 31020 | 84334 |

TABLE 34

Sildenafil dose response

| Sildenafil (μM) | OT-hPDE5-020 | OT-hPDE5-025 | OT-hPDE5-026 |
|---|---|---|---|
| 0.14 | 3771 | 4398 | 3401 |
| 0.41 | 5463 | 4832 | 3681 |
| 1.23 | 10479 | 5031 | 4477 |
| 3.70 | 22441 | 4974 | 7625 |
| 11.11 | 35561 | 5675 | 24104 |
| 33.33 | 52029 | 9677 | 51416 |
| 100.00 | 101226 | 37494 | 136010 |

As shown in Table 33 and Table 34, ligand dose dependent stabilization was obtained with all three constructs. The dose dependent stabilization at lower doses (e.g., up to 11 μM of Sildenafil and Tadalafil) is more evident in the single mutant construct, OT-hPDE5-020, compared to the other two constructs. At higher concentrations of ligand, both OT-hPDE5-025 and OT-hPDE5-026 showed ligand dependent stabilization. In fact, OT-hPDE5-026 construct demonstrated much higher MFI values at 33 and 100 μM, compared to both OT-hPDE5-020 and OT-hPDE5-025. These experiments indicate that combination of single hPDE5 DD mutations produces synergistic effects not predicted by the properties of the single mutants. Thus, suitable hPDE5 DDs may be selected based on the properties of the payload of interest and the expression levels desired,

Example 18. Kinetics of hPDE5 Mutants

The off kinetics of hPDE5 mutants, OT-hPDE5-020 and OT-hPDE5-026 was tested by treating HCT 116 cells expressing these constructs or the wild type control construct OT-hPDE5-019. Cells were treated with ligand for 48 hours. The media containing the ligand was removed and fresh media without the ligand was added. MFI was analyzed by FACS at 0 hours (i.e., prior to the beginning of the experiment), 48 hours after ligand treatment, as well as at several time points after the ligand washout, up until 96 hours. The stabilization ratio was calculated as the fold change in GFP intensity in ligand treated samples compared to the GFP intensity in the absence of ligand with the same construct. The results are shown in Table 35.

TABLE 35

Off-Kinetics

| Time (hrs) | OT-hPDE5-020 MFI | OT-hPDE5-020 Stabilization Ratio | OT-hPDE5-026 MFI | OT-hPDE5-026 Stabilization Ratio | OT-hPDE5-019 (WT) MFI | OT-hPDE5-019 (WT) Stabilization Ratio |
|---|---|---|---|---|---|---|
| 0 | 3675 | — | 3648 | — | 45512 | — |
| 48 | 71538 | 19.47 | 57105 | 15.65 | 102137 | 2.24 |
| 50 | 63832 | 17.37 | 41074 | 11.26 | 97225 | 2.14 |
| 52 | 51544 | 14.03 | 26926 | 7.38 | 96264 | 2.12 |
| 54 | 41800 | 11.37 | 16391 | 4.49 | 95410 | 2.10 |
| 56 | 25521 | 6.94 | 7700 | 2.11 | 81733 | 1.80 |
| 60 | 19598 | 5.33 | 5635 | 1.54 | 84323 | 1.85 |
| 72 | 8062 | 2.19 | 4062 | 1.11 | 70151 | 1.54 |
| 80 | 6427 | 1.75 | 3587 | 0.98 | 63208 | 1.39 |
| 96 | 4319 | 1.18 | 3443 | 0.94 | 55918 | 1.23 |

As shown in Table 35, the stabilization ratio of hPDE5 mutants decreased following removal of the ligand. The stabilization ratio values decreased more quickly in the combination mutant OT-hPDE5-026 compared to OT-hPDE5-020 construct suggesting the destabilization of the DD is achieved more quickly in the OT-hPDE5-026 construct. The ligand dependent stabilization as indicated by the stabilization ratio, achieved with OT-hPDE5-026 construct is lower than OT-hPDE5-020 construct, which may also contribute to the superior off kinetics seen with the OT-hPDE5-026 construct.

Example 19. Behavior of hPDE5 C Terminal Mutants

The ability of hPDE5 mutants to tune the expression of payloads when appended to the C terminal of the payload was tested. OT-hPDE5C-030 was compared to OT-hPDE5C-036. NIH 3T3 cells were incubated with varying doses of Sildenafil or Vardenafil for 48 hours and MFIs were analyzed by FACS. The stabilization ratio (SR) was calculated as the fold change in GFP intensity in ligand treated samples compared to the GFP intensity in the absence of ligand with the same construct. The results are shown in Table 36.

TABLE 36 hPDE5 C-terminal mutant's response to Sildenafil and Vardenafil

| Ligand concentration (nM) | OT-hPDE5C-030 Sildenafil MFI | OT-hPDE5C-030 Sildenafil SR | OT-hPDE5C-030 Vardenafil MFI | OT-hPDE5C-030 Vardenafil SR | OT-hPDE5C-036 Sildenafil MFI | OT-hPDE5C-036 Sildenafil SR | OT-hPDE5C-036 Vardenafil MFI | OT-hPDE5C-036 Vardenafil SR |
|---|---|---|---|---|---|---|---|---|
| 0 | 102 | — | 104 | — | 1476 | — | 1410 | — |
| 100 | 278 | 2.73 | 971 | 9.34 | 1639 | 1.11 | 1614 | 1.14 |
| 300 | 562 | 5.51 | 1165 | 11.20 | 1648 | 1.12 | 1656 | 1.03 |
| 1000 | 1039 | 10.19 | 1235 | 11.88 | 1780 | 1.21 | 1686 | 1.02 |
| 3000 | 1276 | 12.51 | 1299 | 12.49 | 1784 | 1.21 | 1721 | 1.02 |
| 10000 | 1442 | 14.14 | 1309 | 12.59 | 1888 | 1.28 | 1721 | 1.00 |

As shown in Table 36, OT-hPDE5C-030 construct showed stabilization ratios greater than one, indicating that both Vardenafil and Tadalafil ligand could stabilize GFP expression. As expected, the wildtype construct, OT-hPDE5C-036 did not stabilization much greater than one, indicating that virtually no stabilization was achieved with the wildtype construct.

GFP expression was also measured at 24 and 48 hours to monitor the dependence of hPDE5-DD GFP constructs on the duration of ligand exposure. The results are shown in Table 37 and Table 38A, where SR indicates stabilization ratio.

TABLE 37

Dose response of hPDE5 C-terminal mutants with Sildenafil treatment

| Sildenafil concentration (nM) | OT-hPDE5C-030 24 hours MFI | OT-hPDE5C-030 24 hours SR | OT-hPDE5C-030 48 hours MFI | OT-hPDE5C-030 48 hours SR | OT-hPDE5C-036 24 hours MFI | OT-hPDE5C-036 24 hours SR | OT-hPDE5C-036 48 hours MFI | OT-hPDE5C-036 48 hours SR |
|---|---|---|---|---|---|---|---|---|
| 0 | 108 | — | 102 | — | 1385 | — | 1476 | — |
| 100 | 243 | 2.25 | 278 | 2.73 | 1495 | 1.08 | 1639 | 1.11 |
| 300 | 380 | 3.52 | 562 | 5.51 | 1565 | 1.13 | 1648 | 1.12 |
| 1000 | 575 | 5.32 | 1039 | 10.19 | 1669 | 1.21 | 1780 | 1.21 |
| 3000 | 666 | 6.17 | 1276 | 12.51 | 1831 | 1.32 | 1784 | 1.21 |
| 10000 | — | — | 1442 | 14.14 | — | — | 1888 | 1.28 |

TABLE 38A

Dose response of hPDE5 C-terminal mutants with Vardenafil treatment

| Vardenafil concentration (nM) | OT-hPDE5C-030 24 hours MFI | OT-hPDE5C-030 24 hours SR | OT-hPDE5C-030 48 hours MFI | OT-hPDE5C-030 48 hours SR | OT-hPDE5C-036 24 hours MFI | OT-hPDE5C-036 24 hours SR | OT-hPDE5C-036 48 hours MFI | OT-hPDE5C-036 48 hours SR |
|---|---|---|---|---|---|---|---|---|
| 0 | 108 | — | 104 | — | 1360 | — | 1410 | — |
| 100 | 684 | 6.33 | 971 | 9.34 | 1439 | 1.06 | 1614 | 1.14 |
| 300 | 761 | 7.05 | 1165 | 11.20 | 1730 | 1.27 | 1656 | 1.17 |
| 1000 | 863 | 7.99 | 1235 | 11.88 | 1721 | 1.27 | 1666 | 1.18 |
| 3000 | 856 | 7.93 | 1299 | 12.49 | 1606 | 1.18 | 1721 | 1.22 |
| 10000 | 889 | 8.23 | 1309 | 12.59 | 1678 | 1.23 | 1721 | 1.22 |

Consistent with the responses measured at 48 hours, the responses measured at 24 hours showed that the hPDE5 mutant construct stabilized GFP expression as evidenced by the stabilization ratios greater than one, while the wildtype construct, OT-hPDE5C-036 showed stabilization ratios around 1, indicating no ligand dependent stabilization.

Results were consistent between Sildenafil and Vardenafil treatment. It was noted that the stabilization ratios obtained at 48 hours was much greater than the values obtained at 24 hours suggesting, a time dependent stabilization of GFP expression. Similar results were obtained by western blot analysis using a GFP antibody. At 0.1 µM sildenafil, modest stabilization of GFP protein levels was observed via western blot. The stabilization of GFP increased when the cells were treated with 1 µM sildenafil Both 0.1 µM and 1 µM dose of vardenafil showed stabilization of GFP levels. These trends were observed both at 24 hours and 48 hours. All comparisons were made against cells that were not treated with either ligand.

The response of hPDE5C terminal mutants to lower doses of Vardenafil was also tested and is shown in Table 38B.

TABLE 38B

Dose response of hPDE5 C-terminal mutants with Vardenafil treatment

| Vardenafil (nM) | MFI | Stabilization ratio |
| --- | --- | --- |
| 0 | 137 | — |
| 1 | 163 | 1.19 |
| 3 | 230 | 1.68 |
| 10 | 477 | 3.48 |
| 30 | 909 | 6.64 |
| 100 | 1417 | 10.34 |
| 1000 | 1789 | 13.06 |

As shown in Table 38B, the hPDE5C terminal mutant showed a dose dependent stabilization even at lower doses of Vardenafil as indicated by the increase in the stabilization ratio. Thus, even low nano molar doses of Vardenafil are sufficient to induce ligand dependent stabilization of hPDE5 DD.

Example 20. Behavior hPDE5 Luciferase Constructs

PDE5 derived DDs were appended to reporter payload such as luciferase to generate constructs OT-hPDE5-031, OT-hPDE5-032, OT-hPDE5-033, and OT-hPDE5-035 constructs. Such constructs may be useful to study in the dynamics of destabilization and stabilization of DDs in vivo. These constructs were transduced into HCT116 cells. Cells were seeded into 96 well plates at 2000 cells per well and incubated with 1 µM or DMSO Vardenafil for 48 hours. The luciferase activity was then measured using a plate reader assay. Parental untransduced cells were used as a control to measure the background fluorescence levels. The results are shown in Table 39. In Table 39, the stabilization ratio was calculated as the fold change in luciferase signal in Vardenafil treated samples compared to treatment with DMSO (i.e. in the absence of ligand) with the same construct. The destabilizing mutation coefficient was calculated as the fold change in GFP intensity in the hPDE5 mutant constructs compared to the hPDE5 wildtype construct (OT-hPDE5-031) in the absence of the ligand. Destabilizing mutation coefficients less than 1 are desirable. Stabilization ratios greater than 1 are desired in DDs.

TABLE 39

Stability of Luciferase constructs

| Construct | Control (DMSO) | Vardenafil | Destabilizing mutation co-efficient | Stabilization ratio |
| --- | --- | --- | --- | --- |
| Parental cells | 1367.47 | 3824.04 | — | — |
| OT-hPDE5-031 | 85429.26 | 127499.78 | — | 1.49 |
| OT-hPDE5-032 | 88881.46 | 174814.64 | 1.04 | 1.97 |
| OT-hPDE5-033 | 53239.88 | 88918.04 | 0.62 | 1.67 |
| OT-hPDE5-035 | 96460.45 | 269718.66 | 1.13 | 2.80 |

The luciferase signal intensity observed in parental cells that did not express the construct indicated that some of the signal was likely background noise. Construct, OT-hPDE5-033 showed the lowest destabilizing mutation coefficient indicating the construct is destabilized. Increase in stabilization ratios was observed with all constructs including the wildtype hPDE5 construct, OT-hPDE5-031. Construct OT-hPDE5-035 showed the highest stabilization ratio indicating the strongest ligand dependent stabilization. Among the constructs tested, OT-hPDE5-033 showed destabilization in the absence of ligand and stabilization in the presence of ligand.

Example 21. Mutagenesis of the Amino Acid 732 of hPDE5

The analysis of mutants identified by site directed mutagenesis identified amino acid hotspots whose mutation confers destabilization and ligand dependent stabilization properties to hPDE5. The amino acid at position 735 was chosen for the further analysis since the hPDE5 (R732L) mutation possessed the properties described above. To improve the DD characteristics of this DD, the amino acid at the position 732 was mutated to any of the known amino acids, including, but not limited to, aspartic acid, glutamic acid, glutamine, asparagine, histidine, serine, threonine, tyrosine, cysteine, methionine, tryptophan, alanine, isoleucine, leucine, phenylalanine, valine, proline, and glycine. The library of mutations was generated by site directed mutagenesis and each of the mutants in the library was fused to a reporter protein e.g. AcGFP via a linker and transduced into HCT116 cells. The properties of the DDs were analyzed in the presence and absence of ligands via FACS as previously described. Ligands that were evaluated included, but not limited Sildenafil, and Vardenafil. The results are shown in Table 40A and Table 40B.

TABLE 40A

Ligand responsive behavior of hotspot constructs

| | | Vardenafil | | Sildenafil | |
| --- | --- | --- | --- | --- | --- |
| Construct | Mutation | 0 µM (DMSO) | 1 µM | 0 µM (DMSO) | 10 µM |
| OT-hPDE5-001 | — | 161 | 294 | 989 | 219 |
| OT-hPDE5-009 | R732L | 182 | 173 | 143 | 122 |
| OT-hPDE5-064 | R732G | 176 | 854 | 298 | 288 |
| OT-hPDE5-065 | R732A | 175 | 853 | 288 | 348 |
| OT-hPDE5-066 | R732V | 150 | 507 | 189 | 113 |
| OT-hPDE5-067 | R732I | 151 | 587 | 201 | 170 |
| OT-hPDE5-068 | R732P | 355 | 310 | 379 | 361 |
| OT-hPDE5-069 | R732F | 189 | 943 | 233 | 351 |
| OT-hPDE5-070 | R732W | 301 | 179 | 248 | 158 |
| OT-hPDE5-071 | R732Y | 302 | 345 | 397 | 648 |
| OT-hPDE5-072 | R732H | 308 | 328 | 352 | 710 |
| OT-hPDE5-073 | R732S | 566 | 399 | 760 | 746 |

TABLE 40A-continued

Ligand responsive behavior of hotspot constructs

| Construct | Mutation | Vardenafil 0 μM (DMSO) | 1 μM | Sildenafil 0 μM (DMSO) | 10 μM |
|---|---|---|---|---|---|
| OT-hPDE5-074 | R732T | 235 | 270 | 276 | 546 |
| OT-hPDE5-075 | R732D | 294 | 422 | 298 | 394 |
| OT-hPDE5-076 | R732E | 276 | 212 | 295 | 316 |
| OT-hPDE5-077 | R732Q | 305 | 289 | 353 | 553 |
| OT-hPDE5-078 | R732N | 313 | 290 | 315 | 516 |
| OT-hPDE5-079 | R732M | 316 | 337 | 285 | 503 |
| OT-hPDE5-080 | R732C | 526 | 349 | 499 | 707 |
| OT-hPDE5-081 | R732K | 113 | 423 | 165 | 765 |

TABLE 40B

Stabilization ratio and Destabilizing mutation coefficient of hotspot constructs

| Construct | Mutation | Vardenafil Destabilizing mutation coefficient | Stabilization ratio | Sildenafil Destabilizing mutation coefficient | Stabilization ratio |
|---|---|---|---|---|---|
| OT-hPDE5-001 | — | — | 1.83 | — | 0.22 |
| OT-hPDE5-009 | R732L | 1.13 | 0.95 | 0.14 | 0.85 |
| OT-hPDE5-064 | R732G | 1.09 | 4.85 | 0.3 | 0.97 |
| OT-hPDE5-065 | R732A | 1.09 | 4.87 | 0.29 | 1.21 |
| OT-hPDE5-066 | R732V | 0.93 | 3.38 | 0.19 | 0.6 |
| OT-hPDE5-067 | R732I | 0.94 | 3.89 | 0.2 | 0.85 |
| OT-hPDE5-068 | R732P | 2.2 | 0.87 | 0.38 | 0.95 |
| OT-hPDE5-069 | R732F | 1.17 | 4.99 | 0.24 | 1.51 |
| OT-hPDE5-070 | R732W | 1.87 | 0.59 | 0.25 | 0.64 |
| OT-hPDE5-071 | R732Y | 1.88 | 1.14 | 0.4 | 1.63 |
| OT-hPDE5-072 | R732H | 1.91 | 1.06 | 0.36 | 2.02 |
| OT-hPDE5-073 | R732S | 3.52 | 0.7 | 0.77 | 0.98 |
| OT-hPDE5-074 | R732T | 1.46 | 1.15 | 0.28 | 1.98 |
| OT-hPDE5-075 | R732D | 1.83 | 1.44 | 0.3 | 1.32 |
| OT-hPDE5-076 | R732E | 1.71 | 0.77 | 0.3 | 1.07 |
| OT-hPDE5-077 | R732Q | 1.89 | 0.95 | 0.36 | 1.57 |
| OT-hPDE5-078 | R732N | 1.94 | 0.93 | 0.32 | 1.64 |
| OT-hPDE5-079 | R732M | 1.96 | 1.07 | 0.29 | 1.76 |
| OT-hPDE5-080 | R732C | 3.27 | 0.66 | 0.5 | 1.42 |
| OT-hPDE5-081 | R732K | 0.7 | 3.74 | 0.17 | 4.64 |

The destabilizing mutation coefficients and stabilization ratios obtained for each construct with the indicated ligands were analyzed to identify constructs which possessed the lowest destabilizing mutation coefficient ratio and a second sort of the data was then performed to identify constructs with the highest stabilization ratio. This analysis allowed the identification of constructs with both the lowest destabilizing mutation coefficient that also possessed the highest stabilization ratios. Based on this analysis, it was identified that virtually all mutants tested showed destabilizing mutation coefficients less than one for the DMSO control of Sildenafil treatment, indicating that all constructs are destabilized in the absence of sildenafil. In the presence of Sildenafil, OT-hPDE5-081 construct with arginine to lysine substitution showed high sildenafil dependent stabilization ratio. Similar analysis of the constructs with Vardenafil identified OT-hPDE5-081, OT-hPDE5-066, OT-hPDE5-067, and OT-hPDE5-065 as having a low destabilizing mutation coefficient and high-ligand dependent stabilization ratios. Other constructs with low destabilizing mutation coefficients and high stabilization ratios include OT-hPDE5-067, OT-hPDE5-065, OT-hPDE5-069, OT-hPDE5-074, and OT-hPDE5-075.

The response of select mutants to increasing doses of Sildenafil, Vardenafil and Tadalafil was also tested in HCT 116 cells treated with the ligand for 48 hours. The MFI values obtained with each ligand treatment are shown in Table 41A, Table 41B and Table 41C.

TABLE 41A

Vardenafil Dose Response

| Vardenafil (μM) | OT-hPDE5-065 | OT-hPDE5-067 | OT-hPDE5-069 | OT-hPDE5-074 | OT-hPDE5-075 |
|---|---|---|---|---|---|
| 0 | 2551 | 1810 | 2188 | 2854 | 4336 |
| 0.01 | 2551 | 1810 | 2188 | 2854 | 4336 |
| 0.04 | 8345 | 3356 | 8468 | 6862 | 7350 |
| 0.12 | 10946 | 4874 | 10941 | 13187 | 15637 |
| 0.37 | 13850 | 7855 | 12987 | 28895 | 25047 |
| 1.11 | 15202 | 11777 | 13754 | 33075 | 37828 |
| 3.33 | 16783 | 14531 | 14705 | 41788 | 44499 |
| 10 | 18945 | 17645 | 17021 | 48946 | 50822 |
| 30 | 22548 | 24322 | 20693 | 67364 | 70645 |
| 1000 | 22548 | 24322 | 20693 | 67364 | 70645 |

TABLE 41B

Sildenafil Dose Response

| Sildenafil (μM) | OT-hPDE5-065 | OT-hPDE5-067 | OT-hPDE5-069 | OT-hPDE5-074 | OT-hPDE5-075 |
|---|---|---|---|---|---|
| 0.01 | 808 | 579 | 688 | 856 | 1192 |
| 0.04 | 1025 | 612 | 916 | 1041 | 1270 |
| 0.12 | 1270 | 592 | 1205 | 1113 | 1337 |
| 0.37 | 1931 | 771 | 2002 | 1835 | 1867 |
| 1.11 | 2655 | 1040 | 2711 | 3355 | 3108 |
| 3.33 | 3769 | 1709 | 3555 | 6896 | 6171 |
| 10 | 4716 | 2733 | 4427 | 12407 | 13971 |
| 30 | 5694 | 4197 | 5449 | 21258 | 21120 |
| 1000 | 5694 | 4197 | 5449 | 21258 | 21120 |

TABLE 41C

Tadalafil Dose Response

| Tadalafil (μM) | OT-hPDE5-065 | OT-hPDE5-067 | OT-hPDE5-069 | OT-hPDE5-074 | OT-hPDE5-075 |
|---|---|---|---|---|---|
| 0.01 | 752 | 498 | 631 | 825 | 1163 |
| 0.14 | 1259 | 540 | 1193 | 1068 | 1361 |
| 0.41 | 2066 | 712 | 2075 | 1655 | 1548 |
| 1.23 | 3412 | 1041 | 3134 | 3433 | 2504 |
| 3.7 | 4690 | 1745 | 4294 | 6697 | 4821 |
| 11.11 | 5126 | 2746 | 4734 | 12843 | 10583 |
| 33.33 | 6264 | 3970 | 5293 | 17164 | 16956 |
| 100 | 6301 | 5487 | 5867 | 21113 | 22630 |
| 1000 | 6301 | 5487 | 5867 | 21113 | 22630 |

OT-hPDE5-074 with an arginine to threonine substitution showed the strongest increase in GFP expression at the highest dose, with all three ligands tested. At doses lower than 1 μM of Vardenafil, all constructs showed ligand dependent stabilization. At doses of Sildenafil lower than 1 μM, OT-hPDE5-069, OT-hPDE5-074 and OT-hPDE5-075 showed ligand dependent stabilization. With doses of Tadalafil lower than 1 μM, OT-hPDE5-065, OT-hPDE5-069 and OT-hPDE5-074 showed ligand dependent stabilization. By mutagenesis of the R732 locus, DDs with a variety of properties were obtained. The selection of a particular DD may be made based on the payload utilized and the extent of expression desired with the payload. The EC50 values for each of the constructs with each of the ligands is shown in Table 41D.

TABLE 41D

| | EC$_{50}$ for Hotspot Mutants | | | | |
|---|---|---|---|---|---|
| Ligand | OT-hPDE5-065 | OT-hPDE5-067 | OT-hPDE5-069 | OT-hPDE5-074 | OT-hPDE5-075 |
| Vardenafil | 0.30 | 2.20 | 0.28 | 1.47 | 1.44 |
| Sildenafil | 2.08 | 6.90 | 1.76 | 7.50 | 7.04 |
| Tadalafil | 1.45 | 14.28 | 1.33 | 8.64 | 14.54 |

These results are consistent with the western blot analysis of GFP protein levels in HCT 116 cells stably transduced with these mutants. The following constructs showed a strong stabilization of GFP levels in the presence of vardenafil and when compared to DMSO controls: OT-hPDE5-009, OT-hPDE5-064, OT-hPDE5-065, OT-hPDE5-068, OT-hPDE5-070, OT-hPDE5-071, OT-hPDE5-072, OT-hPDE5-073, OT-hPDE5-074, OT-hPDE5-075, OT-hPDE5-076, OT-hPDE5-077, OT-hPDE5-078, OT-hPDE5-079, and OT-hPDE5-080. Modest ligand dependent stabilization of GFP levels was observed with OT-hPDE5-066, OT-hPDE5-067, OT-hPDE5-069, and OT-hPDE5-081. All samples showed equal protein loading as measured by GAPDH protein levels.

Example 22: Dynamic Range of hPDE5 Regulation

HCT116 cells were transduced with hPDE5-GFP constructs, OT-hPDE5-083, OT-hPDE5-084, OT-hPDE5-085, and OT-hPDE5-094 and incubated with the indicated concentrations of ligand for 48 hours. GFP fluorescence was measured by FACS. The fold change in GFP expression over untreated DMSO control is shown in Table 42A, Table 42B and Table 42C for vardenafil, sildenafil and tadalafil respectively.

TABLE 42A

| | Vardenafil dose response | | | |
|---|---|---|---|---|
| Vardenafil (log) | OT-hPDE5-83 | OT-hPDE5-84 | OT-hPDE5-85 | OT-hPDE5-94 |
| 1.477 | 20.664 | 13.612 | 4.507 | 16.171 |
| 1.000 | 18.207 | 12.030 | 2.178 | 13.462 |
| 0.523 | 18.327 | 10.260 | 1.277 | 13.230 |
| 0.046 | 17.229 | 7.465 | 1.078 | 12.550 |
| −0.431 | 16.143 | 4.374 | 1.022 | 11.992 |
| −0.908 | 13.764 | 2.258 | 1.025 | 9.770 |
| −1.386 | 10.108 | 1.323 | 1.015 | 5.477 |
| −1.863 | 4.673 | 0.834 | 1.030 | 2.303 |
| −2.340 | 2.575 | 0.741 | 1.034 | 1.412 |
| −2.817 | 1.744 | 0.725 | 1.047 | 1.105 |

TABLE 42B

| | Sildenafil dose response | | | |
|---|---|---|---|---|
| Sildenafil (log) | OT-hPDE5-83 | OT-hPDE5-84 | OT-hPDE5-85 | OT-hPDE5-94 |
| 2.000 | 11.370 | 14.212 | 1.909 | 11.290 |
| 1.523 | 12.925 | 15.247 | 1.509 | 13.091 |
| 1.046 | 12.066 | 10.028 | 1.212 | 12.344 |
| 0.569 | 10.587 | 5.408 | 1.091 | 10.615 |
| 0.092 | 9.190 | 2.822 | 0.995 | 8.165 |
| −0.386 | 6.849 | 1.640 | 1.040 | 5.536 |
| −0.863 | 4.225 | 1.249 | 0.993 | 2.540 |
| −1.340 | 2.295 | 1.106 | 1.007 | 1.397 |
| −1.817 | 1.434 | 1.025 | 1.013 | 1.134 |
| −2.294 | 1.136 | 1.024 | 0.966 | 0.997 |

TABLE 42C

| | Tadalafil dose response | | | |
|---|---|---|---|---|
| Tadalafil (log) | OT-hPDE5-83 | OT-hPDE5-84 | OT-hPDE5-85 | OT-hPDE5-94 |
| 2.000 | 12.074 | 14.919 | 1.498 | 12.606 |
| 1.523 | 11.481 | 13.740 | 1.224 | 11.910 |
| 1.046 | 9.897 | 8.083 | 1.011 | 11.144 |
| 0.569 | 8.403 | 4.360 | 0.945 | 9.902 |
| 0.092 | 5.445 | 2.312 | 0.973 | 7.992 |
| −0.386 | 2.725 | 1.472 | 0.907 | 5.049 |
| −0.863 | 1.563 | 1.225 | 0.946 | 2.887 |
| −1.340 | 1.121 | 1.034 | 0.938 | 1.402 |
| −1.817 | 1.095 | 1.013 | 0.976 | 1.077 |
| −2.294 | 1.045 | 0.985 | 0.942 | 1.064 |

As shown in Table 42A, Table 42B and Table 42C, dynamic regulation of hPDE5 DDs was observed with OT-hPDE5-083, OT-hPDE5-084, and OT-hPDE5-085. The hPDE5 wildtype construct shown little to no ligand dependent stabilization with all three ligands. The stabilization concentration 50 or ($SC_{50}$), which is the concentration of ligand required to achieve 50% stabilization, was also calculated for all four constructs with each of the ligands and the results are shown Table 42D.

TABLE 42D

| | Stabilization Concentration 50 ($SC_{50}$) of hPDE5 DDs | | | |
|---|---|---|---|---|
| Ligand | OT-hPDE5-83 | OT-hPDE5-84 | OT-hPDE5-85 | OT-hPDE5-94 |
| Vardenafil | 0.04 | 1.15 | >30 | 0.07 |
| Sildenafil | 0.38 | 6.82 | >30 | 0.67 |
| Tadalafil | 1.97 | 9.54 | >100 | 0.77 |

Taken together these results indicate that structure-guided mutagenesis of ligand-binding site in PDE5 generates 23 nM ligand-DD interaction. OT-hPDE5-083 with Y612F, R732L, was able to bind to Vardenafil with $SC_{50}$, of 23 nM suggesting potent DD-ligand interaction.

Example 23. DD Regulated IL15-IL15-Ra Expression In Vitro

Immunotherapeutic payloads of the invention such as, IL15-IL15Ra fusion proteins, were fused to any of the DDs described herein and cloned into expression vectors, such as pLVX and pELNS vectors. To test ligand dependent IL15-IL15Ra production, HEK293T cells were transiently transfected with the constructs. Cells were then plated in DMEM with 10% FBS and incubated overnight at 37° C., 5% CO2. The growth media was exchanged for media containing ligand, e.g. Vardenafil at 10 µM. Following 48-hour incubation with ligand, cells were lysed and immunoblotted using antibodies specific to IL15Ra. hPDE5-DDs were able to regulate IL15Ra levels in the presence of Vardenafil with all three constructs tested OT-IL15-043, OT-IL15-044 and OT-IL15-045. In contrast, the IL15Ra levels remained unchanged both in the presence and absence of ligand with the constitutive construct, OT-IL15-008. It was noted that the ligand dependent stabilization was accompanied by an upward shift in the mobility of IL15Ra only in the presence of Vardenafil, indicating that the stabilization is likely accompanied by a post translation protein modification. Uniform loading of samples was demonstrated using actin as a loading control.

The effects of vector backbone on the expression of the payload were examined by cloning the OT-IL15-031 construct into the pELPS vector backbone to generate the OT-IL15-079 construct. The constructs were transduced into HEK293T cells and IL15Ra expression was assayed as described above. Only OT-IL15-031 showed vardenafil dependent stabilization of IL15Ra protein levels. Only modest ligand dependent stabilization was observed with the OT-IL15-079 construct in the presence of vardenafil.

The IL15 levels were also examined using the MSD assay. The growth media was harvested from the cells expressing IL15-IL15Ra and that were exposed to 10 μM Vardenafil or vehicle control for 48 hours. The results are shown in Table 43, where the stabilization ratio was defined as the ratio of expression, function or level of a protein of interest, i.e. IL15-IL15Ra in response to the stimulus, i.e. Vardenafil; to the expression, of the IL15-IL15Ra in the absence of the stimulus, i.e. DMSO control. The destabilization ratio was calculated as the ratio of expression, of IL15Ra in the absence of the stimulus specific to the effector module i.e. Vardenafil to the expression, function or level of the protein of interest, that is expressed constitutively (OT-IL15-008) and in the absence of the stimulus specific to the SRE. Stabilization ratios greater than one and destabilization ratios less than one are desired.

TABLE 43

IL15 levels (pg/ml)

| Construct | Control | Vardenafil | Destabilization ratio | Stabilization ratio |
|---|---|---|---|---|
| OT-IL15-008 | 710.73 | 799.39 | — | 1.12 |
| OT-IL15-043 | 63.37 | 93.63 | 0.09 | 1.48 |
| OT-IL15-044 | 193.09 | 203.21 | 0.27 | 1.05 |
| OT-IL15-045 | 255.05 | 320.39 | 0.36 | 1.26 |

As shown in Table 43, all three hPDE5 regulated constructs showed destabilization ratios less than one indicating destabilization in the absence of ligand. OT-IL15-043 appeared to be the most destabilized construct. It was also the most ligand-stabilized construct, with the highest stabilization ratio.

Expression of OT-IL15-031 construct was also analyzed in HCT-116 cells via western blot. The cells were exposed to 10 μM Vardenafil for 48 hours and IL15 and IL15Ra levels were analyzed by western blot. Similar to the HEK293T cells, HCT 116 cells also displayed a Vardenafil dependent stabilization with a concomitant upward shift in mobility of IL15Ra protein indicating protein modifications.

Example 24. Effect of Linker on DD Regulation of IL15-IL15Ra

The effect of the type of linker used and the length of the linker on the regulation of the expression of the payload was tested. IL15-IL15Ra fusion constructs were linked to the hPDE5 (R732L) DD using GSGSGS (SEQ ID NO. 8330) as the linker (as in OT-IL15-111), or GSGSGSGS (SEQ ID NO. 8331) as the linker (as in OT-IL15-112) or using GSGSGGGSGS (SEQ ID NO. 8332) as the linker (as in OT-IL15-113). The IL15 portion of the construct was tagged with a Flag tag while the IL15Ra portion was tagged with a HA tag. These tags allow both the components of the construct to be tracked individually in experiments. The constructs were transiently transfected into HEK293T cells and then incubated with 1 μM Vardenafil for 24 hours. The properties of the DDs regulated IL15-IL15Ra payloads were analyzed in the presence and absence of ligands via FACS using the HA antibody as previously described. The results are shown in Table 44, where the stabilization ratio was defined as the ratio of expression, function or level of a protein of interest, i.e. IL15-IL15Ra in response to the stimulus, i.e. Vardenafil; to the expression, of the IL15-IL15Ra in the absence of the stimulus, i.e. DMSO control treated samples.

TABLE 44

% HA positive cells with different linkers

| Construct Name | Control | Vardenafil | Stabilization ratio |
|---|---|---|---|
| OT-IL15-111 | 37.5 | 63.2 | 1.69 |
| OT-IL15-112 | 41.6 | 74.6 | 1.79 |
| OT-IL15-113 | 42 | 69.1 | 1.65 |

As shown in Table 44, all three constructs each with a different linker resulted in a somewhat similar stabilization ratio, indicating that linker length and identity did not impact regulation of the payload by the DD. All three constructs also had a stabilization ratio greater than one suggesting that the payload expression was stabilized in the presence of the ligand. Among the three constructs tested OT-IL15-112 showed a slightly higher stabilization ratio than the other two constructs indicating that the use of the GSGSGSGS linker may result in a slightly improved ligand dependent stabilization.

Example 25. DD Regulated CD19 CAR Expression and Function

Immunotherapeutic payloads of the invention such as CD 19 CAR were fused to any of the DDs described herein and cloned into expression vectors pLVX and pELNS vectors. In this manner, OT-CD19-052 (hPDE5 (WT)) and OT-CD19-053 (hPDE5(R732L)). The HA tag was added to enable the easy detection of the chimeric proteins.

To test ligand dependent CD19 CAR production, NIH 3T3 cells were transiently transfected with the constructs. Cells were then plated in a growth media e.g. DMEM with 10% FBS and incubated overnight at 37° C., 5% CO2. The growth media was exchanged for media containing ligand, at various concentrations of Vardenafil ranging from 30 nM to 10,000 nM. Following 48-hour incubation with ligand, cells were analyzed by FACS using the HA antibody and the mean fluorescence intensity (MFI) was calculated. The results are shown in Table 45A, where the stabilization ratio was defined as the ratio of expression, function or level of a protein of interest, i.e. CD19 CAR in response to the stimulus, i.e. Vardenafil; to the expression, of the CD19 CAR in the absence of the stimulus, i.e. DMSO control. Stabilization ratios greater than one are desired.

TABLE 45A

CD19 CAR expression

| Vardenafil (nM) | OT-CD19-052 (WT) MFI | OT-CD19-053 (R732L) MFI | Stabilization ratio |
|---|---|---|---|
| 0 | 0 | 1336 | — |
| 30 | 9125 | 3066 | 2.29 |
| 100 | 9592 | 4674 | 3.50 |

TABLE 45A-continued

CD19 CAR expression

| Vardenafil (nM) | OT-CD19-052 (WT) MFI | OT-CD19-053 (R732L) MFI | Stabilization ratio |
|---|---|---|---|
| 300 | 10509 | 5732 | 4.29 |
| 1000 | 10328 | 6738 | 5.04 |
| 10000 | 9285 | 3931 | 2.94 |

As shown in Table 45A, a stabilization ration greater than 1 was observed with all doses of Vardenafil, and even with the lowest concentration of Vardenafil (30 nM) suggesting that low doses of ligand may be sufficient to achieve ligand dependent stabilization. It was also noted that the stabilization ratio obtained at the highest concentration of ligand i.e. 10,000 nM was lower than the ratio obtained with 1000 nM ligand suggesting a bimodal pattern of stabilization.

The dose dependent regulation of OT-CD19-052 and OT-CD19-053 was measured in HEK 293 cells transfected with 2 ug DNA and stably selected using 2 ug/ml puromycin. CAR surface expression was detected using Protein L staining following 24 hours of ligand treatment at the indicated concentrations. The median Protein L fluorescence is shown in Table 45B.

TABLE 45B

Ligand dose dependent CAR expression

| | Tadalafil | | | Sildenafil | | | Vardenafil | | |
|---|---|---|---|---|---|---|---|---|---|
| Ligand (nM) | OT-CD19-052 | OT-CD19-053 | Empty Vector (pLVX) | OT-CD19-052 | OT-CD19-053 | Empty Vector (pLVX) | OT-CD19-052 | OT-CD19-053 | Empty Vector (pLVX) |
| 0.15 | 21122 | 4064 | 77 | 14703 | 2848 | 89.8 | 17946 | 4202 | 87.9 |
| 0.46 | 15335 | 3501 | 75.8 | 15335 | 3304 | 87 | 17746 | 4064 | 92 |
| 1.39 | 14662 | 3501 | 78.8 | 13143 | 3250 | 83.9 | 16175 | 4604 | 89.8 |
| 4.22 | 14377 | 3341 | 77 | 13901 | 2810 | 85.7 | 16450 | 5977 | 93.9 |
| 12.79 | 10773 | 3599 | 78.8 | 9419 | 2976 | 81.8 | 17646 | 9210 | 92 |
| 38.74 | 14098 | 4042 | 80 | 12083 | 3268 | 84.8 | 16175 | 13329 | 94.8 |
| 117.41 | 18354 | 6302 | 77 | 15037 | 3589 | 83 | 19856 | 20594 | 93.9 |
| 355.78 | 13785 | 11235 | 72.9 | 13901 | 5274 | 83.9 | 22406 | 23175 | 95.8 |
| 1078.11 | 18200 | 15640 | 80 | 13708 | 8054 | 88.8 | 22343 | 31138 | 97.7 |
| 3267.00 | 15950 | 21301 | 75.8 | 14337 | 13291 | 84.8 | 24933 | 31226 | 100 |
| 9900.00 | 21421 | 24654 | 75.8 | 17746 | 23371 | 84.8 | 26824 | 36249 | 110 |
| 30000.00 | 27902 | 33691 | 77 | 25003 | 25215 | 84.8 | 30617 | 35945 | 140 |

As shown in Table 45B, only OT-CD19-053 responded to increasing doses of ligand with increase surface CAR expression, but not the WT construct OT-CD19-052. This was observed with all three ligands. However, the highest levels of CAR expression were observed with increasing doses of vardenafil. The EC50 for vardenafil, tadalafil and sildenafil were determined to 25 nM, 380 nM, and 1500 nM respectively.

Cells were also treated with ligand for varying durations of time with ligand concentrations shown in Table 45C and Protein L expression was measured using FACS. The results are shown in Table 45C and Table 45D. Stabilization ratios are shown in Table 45E.

TABLE 45C

Time dependent increase in CAR expression with Vardenafil

| | Vardenafil 10 µM | | | Vardenafil | DMSO | | |
|---|---|---|---|---|---|---|---|
| Hours | Empty Vector (pLVX) | OT-CD19-052 | OT-CD19-053 | 1 uM OT-CD19-053 | OT-CD19-052 | OT-CD19-053 | Empty Vector (pLVX) |
| 0 | 1412 | 5188 | 1486 | 65.9 | 5060 | 1386 | 71.9 |
| 2 | 2863 | 11643 | 2918 | 78.7 | 5545 | 1270 | 71 |
| 4 | 3654 | 11258 | 3526 | 76.8 | 5408 | 1274 | 71.9 |
| 24 | 6624 | 10439 | 8005 | 83.7 | 5845 | 1241 | 71 |
| 48 | 7764 | 8118 | 8489 | 93.8 | 6128 | 1287 | 71 |
| 72 | 9282 | 7961 | 9788 | 92.8 | 6442 | 1329 | 65.9 |

TABLE 45D

Time dependent increase in CAR expression with Tadalafil and Sildenafil

| Hours | Tadalafil 10 µM | | | Tadalafil 1 µM | Sildenafil 10 µM | | | Sildenafil 1 µM |
|---|---|---|---|---|---|---|---|---|
| | Empty Vector (pLVX) | OT-CD19-052 | OT-CD19-053 | OT-CD19-053 | Empty Vector (pLVX) | OT-CD19-052 | OT-CD19-053 | OT-CD19-053 |
| 0 | 65 | 4909 | 1336 | 1368 | 62.8 | 5469 | 1534 | 1372 |
| 2 | 65 | 5911 | 2778 | 2451 | 65 | 8536 | 2801 | 2278 |
| 4 | 65 | 6196 | 3032 | 2950 | 63.7 | 8560 | 3256 | 2617 |
| 24 | 65 | 8608 | 6606 | 4346 | 62.8 | 8118 | 5499 | 3159 |
| 48 | 62.8 | 8827 | 7384 | 4683 | 62.8 | 7404 | 5927 | 3283 |
| 72 | 58.7 | 8118 | 8050 | 6027 | 58.7 | 6111 | 5188 | 3506 |

TABLE 45E

Time dependent increase in CAR expression

| Time (hrs) | Tadalafil 10 µM | | Tadalafil 1 µM | Sildenafil 10 µM | | Sildenafil 1 µM | Vardenafil 10 µM | Vardenafil 1 µM | |
|---|---|---|---|---|---|---|---|---|---|
| | OT-CD19-052 | OT-CD19-053 | OT-CD19-053 | OT-CD19-052 | OT-CD19-053 | OT-CD19-053 | OT-CD19-052 | OT-CD19-053 | OT-CD19-053 |
| 0 | 0.97 | 0.96 | 0.99 | 1.08 | 1.11 | 0.99 | 1.03 | 1.07 | 0.05 |
| 2 | 1.07 | 2.19 | 1.93 | 1.54 | 2.21 | 1.79 | 2.10 | 2.30 | 0.06 |
| 4 | 1.15 | 2.38 | 2.32 | 1.58 | 2.56 | 2.05 | 2.08 | 2.77 | 0.06 |
| 24 | 1.47 | 5.32 | 3.50 | 1.39 | 4.43 | 2.55 | 1.79 | 6.45 | 0.07 |
| 48 | 1.44 | 5.74 | 3.64 | 1.21 | 4.61 | 2.55 | 1.32 | 6.60 | 0.07 |
| 72 | 1.26 | 6.06 | 4.53 | 0.95 | 3.90 | 2.64 | 1.24 | 7.36 | 0.07 |

The analysis of the stabilization ratios indicated that OT-CD19-053 is stabilized by all three ligands with increased duration of incubation time with ligand. As expected, 10 µM dose of ligand showed much greater expression of CAR than the 1 µM dose. Regulation was evident even at the lower doses.

Constructs OT-CD19-130, OT-CD19-131 and OT-CD19-132 were cloned into pELNS vectors and transduced into T cells. Three different volumes of lentiviral supernatant were tested on cells i.e. 1 µl, 10 µl and 20 µl. Following transduction, cells were treated with 10 µM Vardenafil or left untreated for 24 hours beginning on day 4. Untransduced cells were also included as negative control. On day 5, the percentage CAR positive cells were measured by FACS using 1 µg/ml CD19 Fc. The results are shown in FIG. 19A.

Figure 19A:
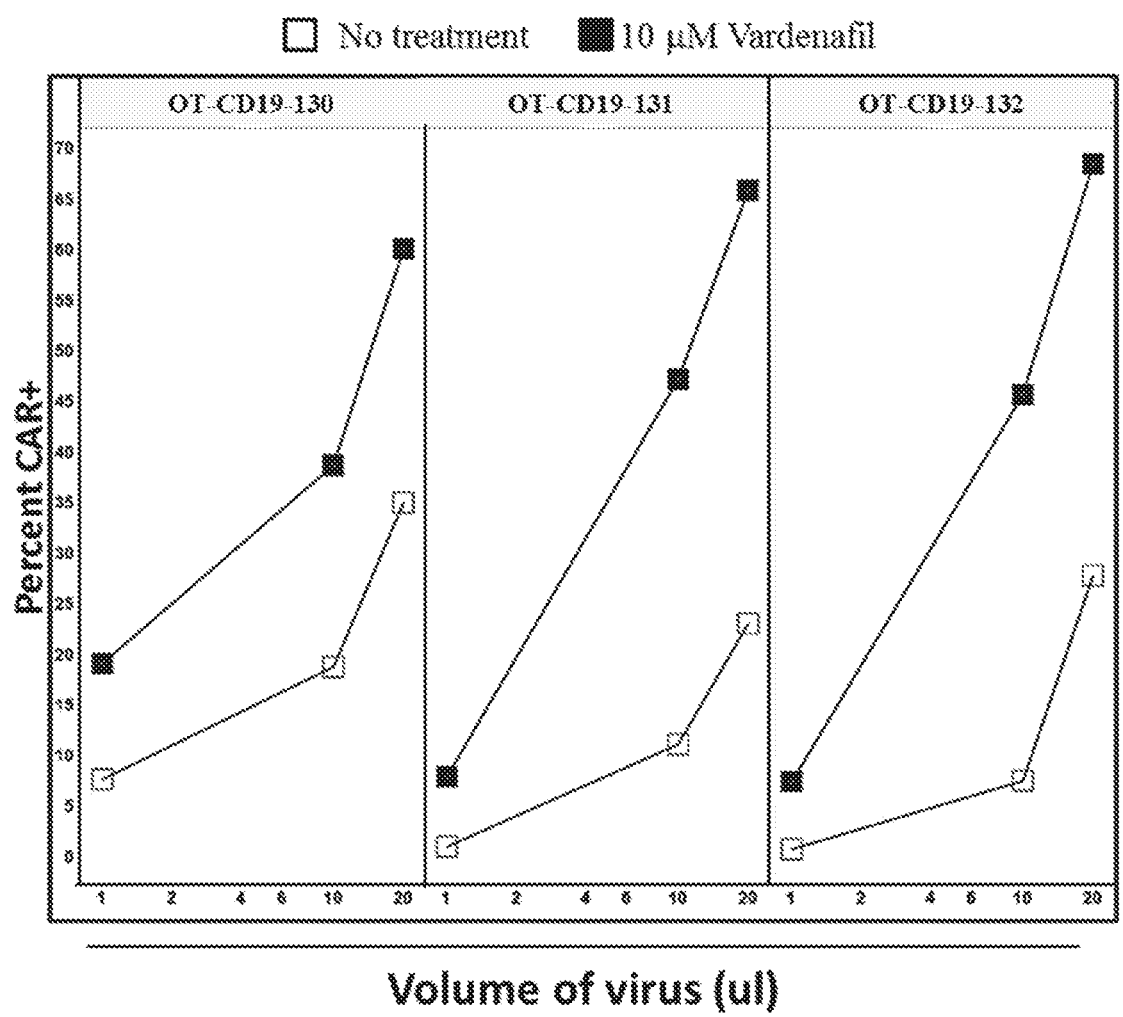
FIG. 19A shows the percent of CAR positive cells obtained with cells transduced with different volumes of virus related to the CAR constructs.
Figure 19B:
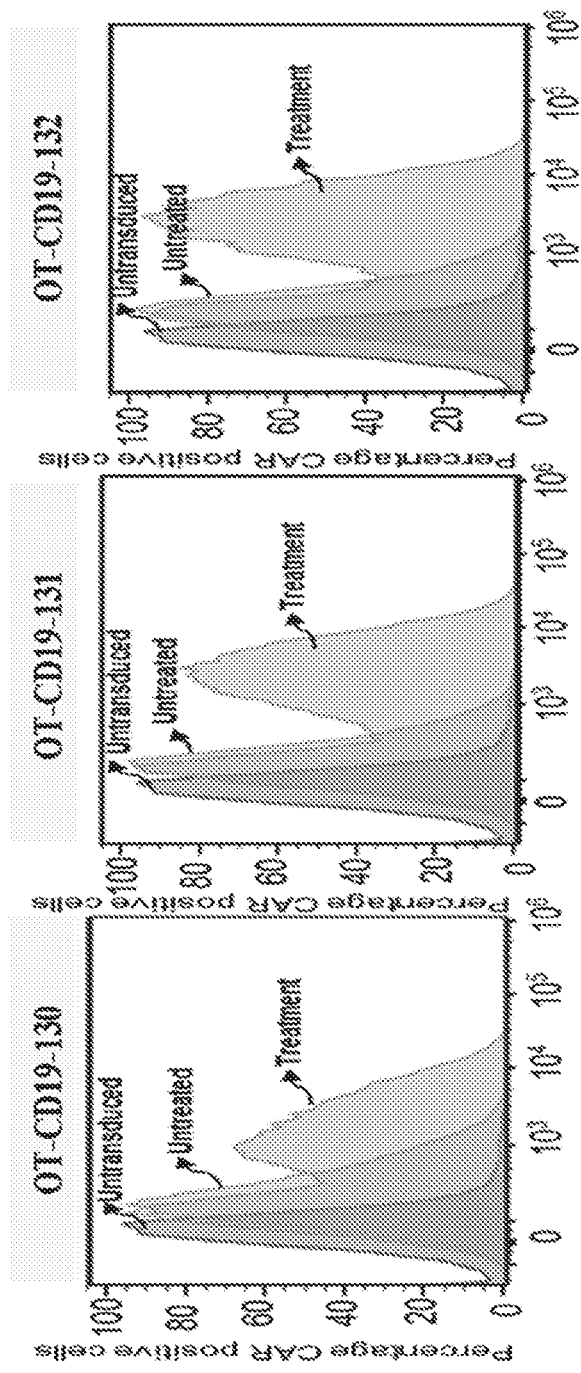
FIG. 19B shows the percentage of CAR positive cells with vardenafil treatment.

As shown in FIG. 19A, all three constructs showed a viral dose dependent increase in the percentage of CAR positive cells, in the presence of Vardenafil. Although similar trends were observed in untreated controls, the percentage of CAR positive cells observed with no vardenafil treatment was substantially lesser than the vardenafil treated controls. Among the three constructs, OT-CD19-132 showed lowest basal expression of the CAR in the absence of ligand and the highest percentage of CAR positive cells in the presence of vardenafil. Similar observations were made when comparing the percentage CAR positive cells obtained with different constructs using 20 µl of virus as shown in FIG. 19B, where a shift in the number of cells that are CAR positive was observed in vardenafil treated cells (labelled treatment) compared to untransduced as well as untreated cells.

Figure 19C:
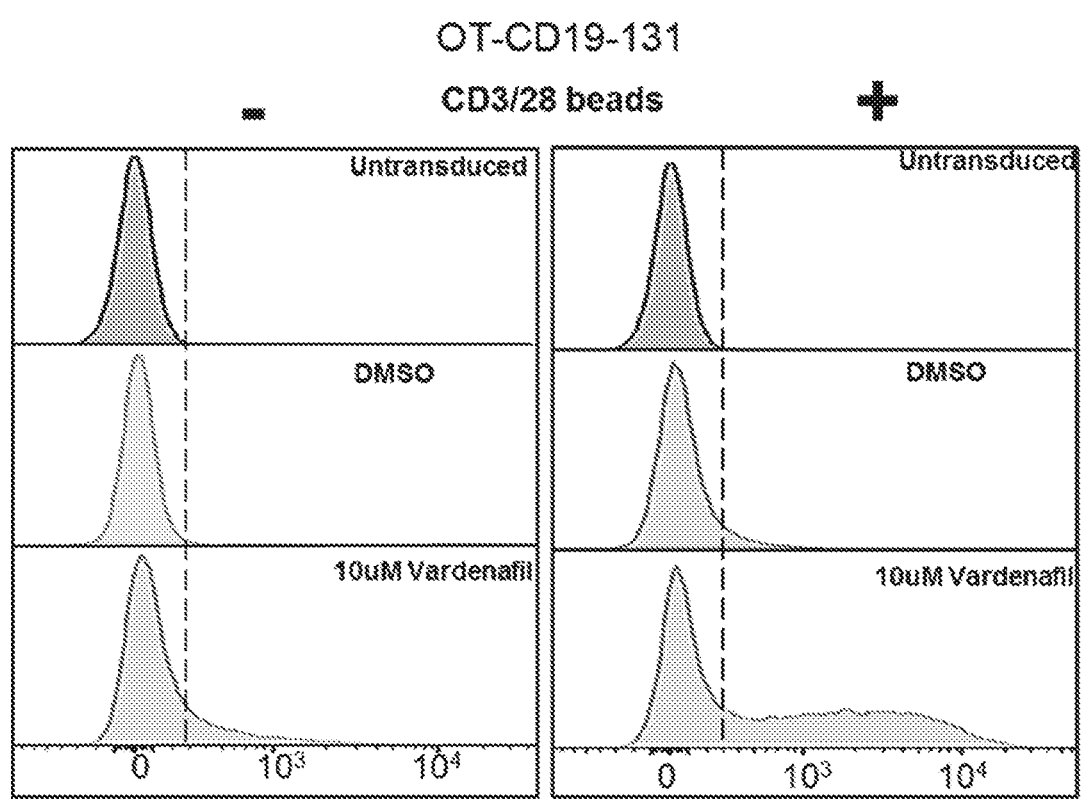
FIG. 19C shows the expression of the CAR with CD3/CD28 bead restimulation.
Figure 19D:
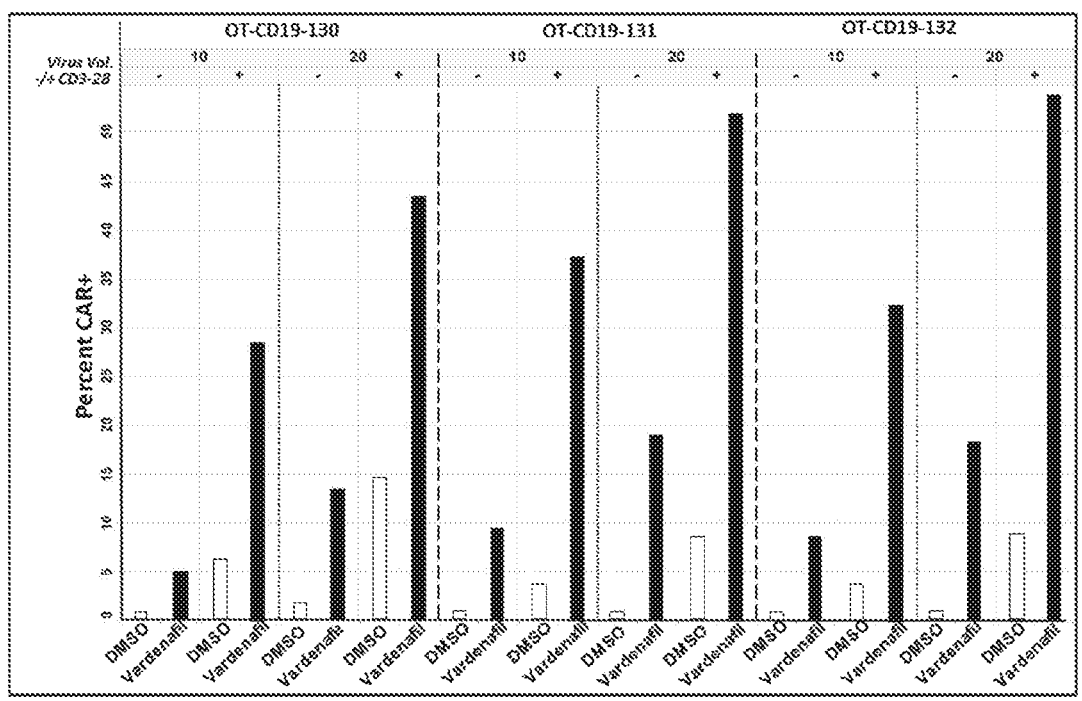
FIG. 19D shows the percentage of CAR positive cells with different concentrations of virus and in the presence or absence of CD3/CD28 bead restimulation.

T cells maintained in culture for over 10 days reach quiescence and accordingly T cells transduced with OT-CD19-131 did not show vardenafil dependent CAR expression at day 11. However, restimulation of the same T cells on day 11 with CD3/CD28 beads (at 3:1 bead:cell ratio, for 24 hours concomitant with ligand treatment) restored vardenafil dependent CAR expression in T cells transduced with 20 µl of virus (FIG. 19C). The effect of restimulation on the expression of the CAR was evident at all concentrations of the virus tested FIG. 19D. Taken together, these data show that CD19 CARs operably linked to hPDE5 DDs demonstrate ligand dependent CAR expression. Further, ligand responsiveness and subsequent CAR expression may be restored in quiescent T cells by restimulation with CD3/CD28 beads.

Figure 19E:
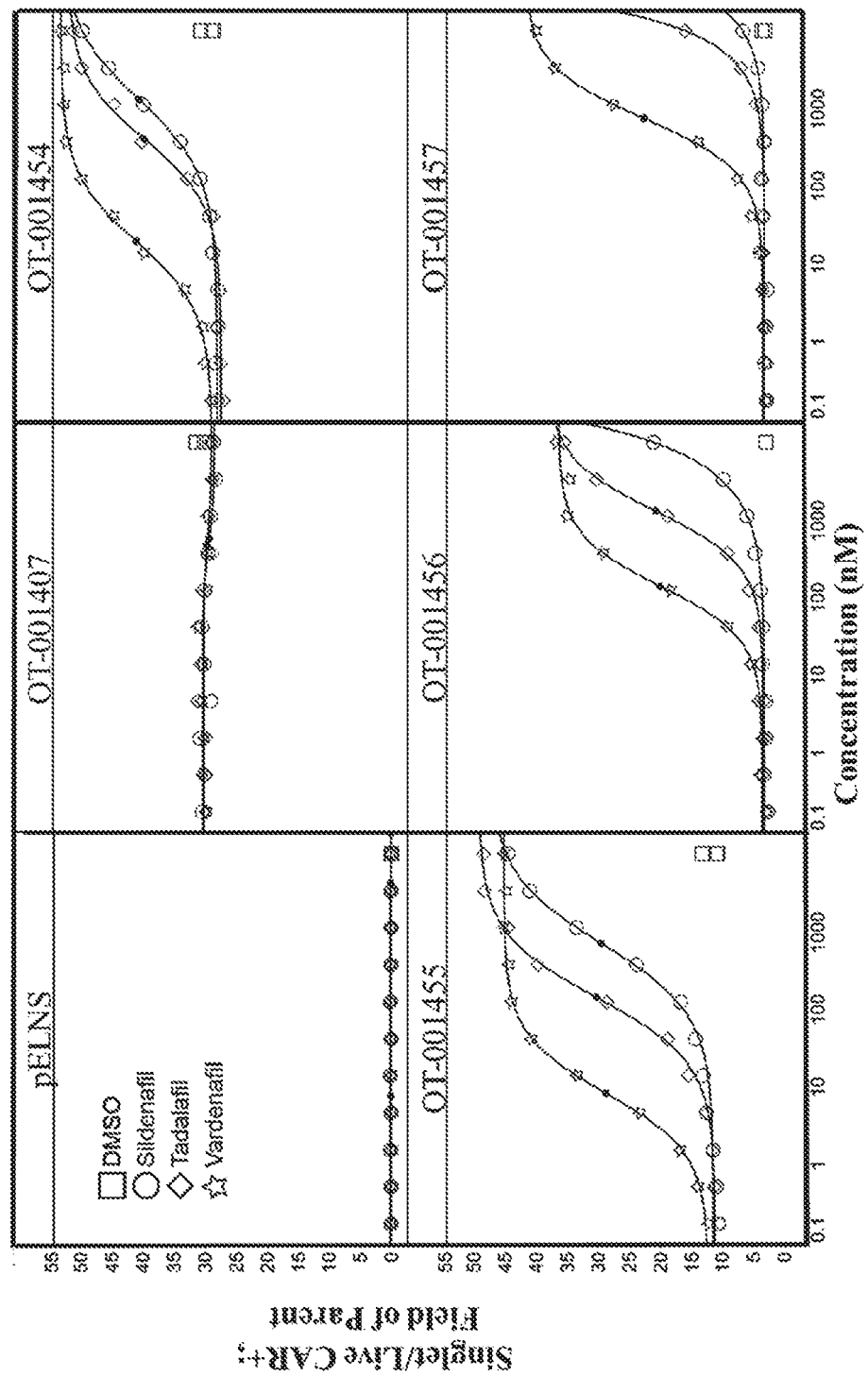
FIG. 19E shows the dose response of CD19 CAR constructs to sildenafil, vardenafil and tadalafil.

To test the effect on different ligands on hPDE5-CAR constructs, the constructs were packaged into plasmids and transduced into T cells using 10 µl of virus. On day 9, T cells expressing either OT-CD19-111, OT-CD19-130, OT-CD19-131 or OT-CD19-132 were treated with varying doses of ligand ranging from 0.1 nM to 10 µM for 24 hours. The constitutive construct OT-CD19-063 was included as the positive control, and the cells transduced with the empty vector (pELNS) served as the negative control. Three different ligands for hPDE5 were tested including, Sildenafil, Tadalafil and Vardenafil. Cells were analyzed by FACS and sorted for singlets/live CAR positive cells. The results are shown in FIG. 19E. Among the three ligands tested, all constructs were most responsive to Vardenafil, followed by Tadalafil and Sildenafil. As seen previously, the OT-CD19-131 and OT-CD19-132 showed lower basal expression, and had the higher EC50 values than the other constructs. The experiments were repeated with the OT-CD19-131 construct by transducing T cells with different volumes of virus transduced into T cells using 10 µL, 2 µL, 0.4 µL, or 0.08 µL of virus and the CAR expression was measured by FACS, both in the presence of all three ligands and in the absence of the ligands. The results are shown in Table 45F, where "basal % CAR+" indicates the percentage of CAR positive cells in the absence of ligand, and the "Max % CAR+," indicates the maximum expression of the CAR in the presence of ligand. The EC50 is defined as the concentration of a drug/ligand that gives half-maximal response. The response herein refers to the expression of the chimeric antigen receptor.

TABLE 45F hPDE5 regulation of CD19-CAR

| Construct | Virus Volume (uL) | Basal % CAR+ | Max % CAR+ | Vardenafil EC50 (nM) | Tadalafil EC50 (nM) | Sildenafil EC50 (nM) |
|---|---|---|---|---|---|---|
| Empty vector (pELNS) | 1 | 0.2 | 0.2 | — | — | — |
| OT-CD19-063 | 1 | 30.0 | 30.0 | — | — | — |
| OT-CD19-131 | 10 | 3.6 | 37.5 | 140.0 | 1312.2 | >10000.0 |
| OT-CD19-131 | 2 | 2.0 | 29 | 157.0 | 1402.8 | >10000.0 |
| OT-CD19-131 | 0.4 | 0.9 | 16.1 | 197.7 | 2511.9 | >10000.0 |
| OT-CD19-131 | 0.08 | 0.4 | 5.0 | 220.8 | 1857.8 | >10000.0 |

Among the three ligands tested, higher transduction volume increased the maximum CAR expression level achieved, but did not alter ligand EC50 values.

Figure 19F:
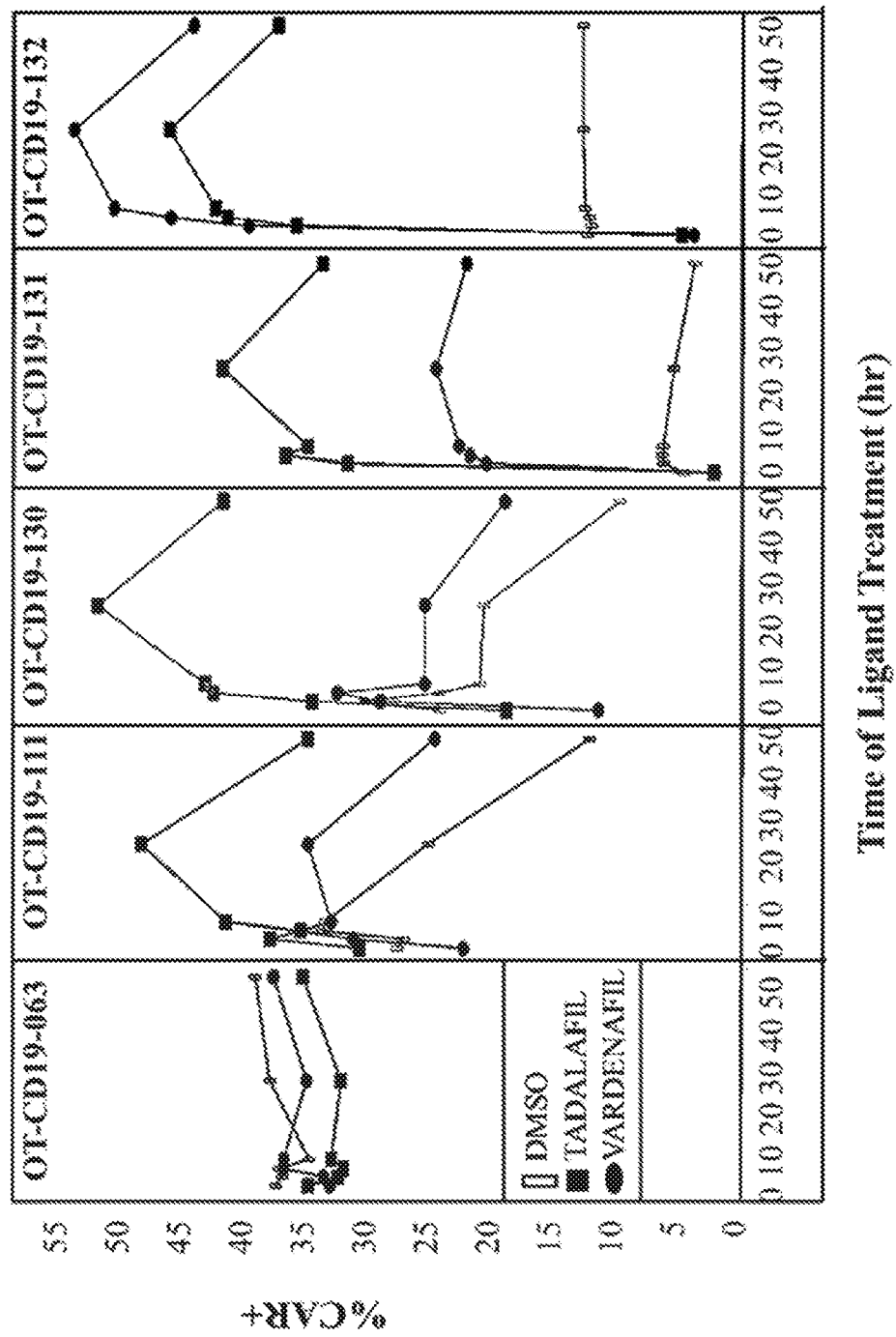
FIG. 19F shows the response of CD19 CAR constructs to different ligands and with varying the duration of ligand treatment.

To test how rapidly hPDE5-CAR can be stabilized with ligand, the indicated constructs were tested in T cells. T cells from donor were thawed and activated overnight in the presence of CD3/CD28 Dynabeads at a 3:1 bead:cell ratio. The following day, cells were transduced with 10 µL lentivirus prepared from OT-CD19-063, OT-CD19-111, OT-CD19-130, OT-CD19-131, and OT-CD19-132 constructs. Cells were expanded by addition of fresh media over the course of 10 days, maintaining cells around 0.5×10A6 cells/mL, then frozen. Expanded T cells were thawed and restimulated with CD3/CD28 beads for 48 hours. Cells were treated with 10 µM Tadalafil or Vardenafil at various times such that all conditions received 48 hr of bead stimulation with either 0, 2, 4, 6, 24, or 48 hours of ligand treatment. CAR surface expression was measured with 1 µg/mL CD19-Fc. The results are shown in FIG. 19F. In activated T cells, CAR surface expression occurred at nearly maximum levels by 2 hours after ligand addition.

To test whether CD19-CARs showing regulated expression also show regulated cytotoxicity, transduced T cells were tested in a cytotoxicity assay against the CD19-expressing Nalm6 tumor cell line, T cells from a human donor were thawed and activated overnight in the presence of CD3/CD28 Dynabeads at a 3:1 bead:cell ratio. The following day, cells were transduced with 10 µL lentivirus from OT-CD19-063, OT-CD19-111, OT-CD19-130, OT-CD19-131, and OT-CD19-132. Cells were expanded by addition of fresh media over the course of 10 days, maintaining cells around 0.5×10A6 cells/mL, then frozen. Expanded T cells were thawed and cocultured with CD19 expressing target cells, Nalm6-Katushka, at effector:target cell ratio of 10:1 for 6 days, in the absence or presence of Tadalafil. Images captured on the Incucyte Zoom were analyzed for proliferation of target cells by measuring red fluorescence over time (Total NucRed Area). In the absence of ligand, i.e. DMSO, OT-CD19-131 and OT-CD19-132 showed target cell proliferation as measured by the increase in total NucRed area (red fluorescence). Constructs, OT-CD19-130, OT-CD19-111 showed very low levels of red fluorescence indicating basal activity that was comparable to the constitutively expressed CAR construct OT-CD19-063. All constructs tested showed a reduction in red fluorescence when treated with either 3 µM Tadalafil or 10 µM Tadalafil that was comparable to the red fluorescence levels observed with the constitutively expressed CAR. As expected, the untransduced cells showed high levels of red fluorescence both in the presence and absence of ligand.

Constructs showing higher basal CAR expression in T cells, OT-CD19-111 and OT-CD19-130, inhibited target cell growth in the absence of tadalafil. T cells transduced with OT-CD19-132, which had the highest Tadalafil EC50 in terms of CAR expression, required higher concentrations of ligand to generate an in vitro functional response.

To measure cytokine levels in T cells, supernatants from the previous coculture assay were harvested at 48 hours and analyzed for IFNγ and IL2 levels by MSD assay (Meso Scale Discovery's ELISA). The results are shown in FIG. 19G. The cytokine levels at the following effector to target cell rations: 10:1, 3:1, 1:1, 0.3:1, and 0.1:1. High levels of both IFNγ and IL2 are produced by OT-CD19-131 transduced T cells when co-cultured with Nalm6 targets only in the presence of 3 µM Tadalafil, correlating with the cytotoxicity observed.

Figure 19H:
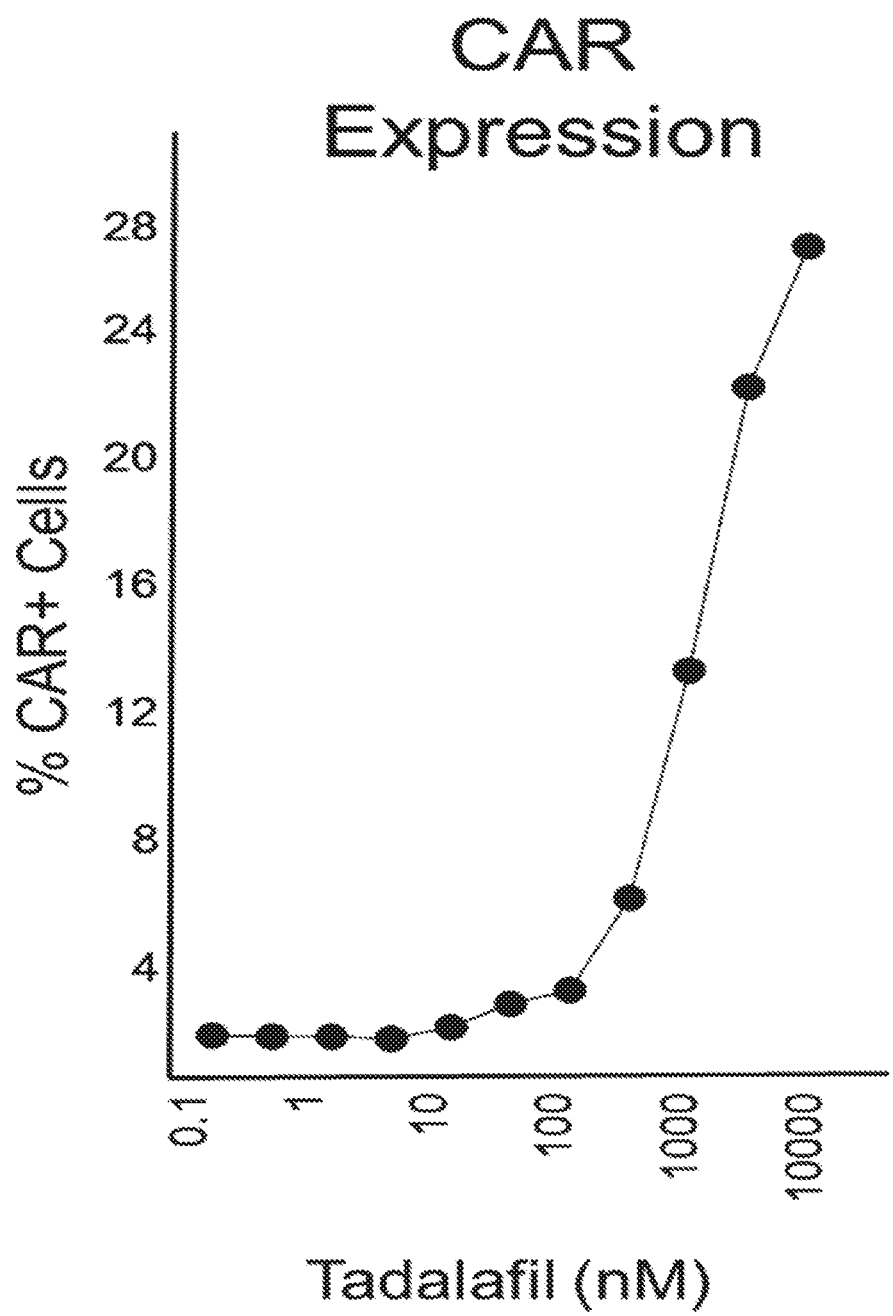
FIG. 19H shows the percentage of CAR positive T cells obtained with Tadalafil treatment.
Figure 19I:
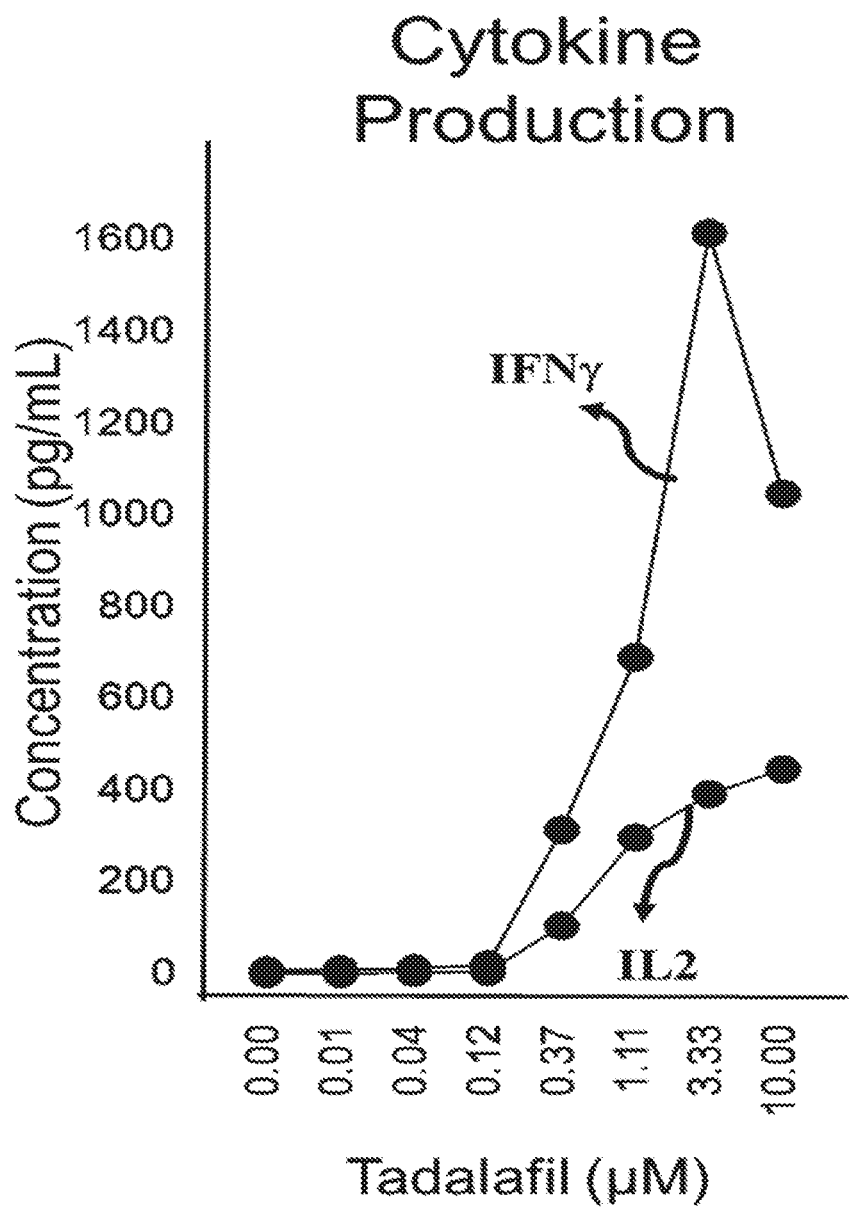
FIG. 19I shows the IL2 and IFNγ levels obtained from the supernatants of cocultures of effector and target cells in the presence of tadalafil.

To confirm the cytotoxicity and cytokine secretion is directly related to CAR expression, OT-CD19-131 transduced T cells were cocultured with Nalm6-Katushka target cells at 10:1 effector:target cell ratio for 6 days in the presence of a dose titration of Tadalafil from 10 µM to 10 nM. The fluorescence of Nalm6 cells was measured over a period of 6 days in response to the following doses of tadalafil: 0.01 µM, 0.04 µM, 0.12 µM, 0.37 µM, 1.11 µM, 3.33 µM, 10 µM. Tadalafil doses at 0.37 µM, 1.11 µM, 3.33 µM, 10 µM showed a reduction in Nalm6 proliferation over 6 days. Lower concentrations (<0.37 µM) tadalafil did not cause a reduction in Nalm6 fluorescence, in fact, Nalm6 cells continue to proliferate over the span of 6 days. Significant CAR expression was detected by FACS using CD19-Fc at Tadalafil concentrations at or above 300 nM. This CAR expression corresponded to Tadalafil dose-dependent cytotoxicity (FIG. 19H) and cytokine secretion of IFNγ and IL2 (FIG. 19I).

Figure 19J:
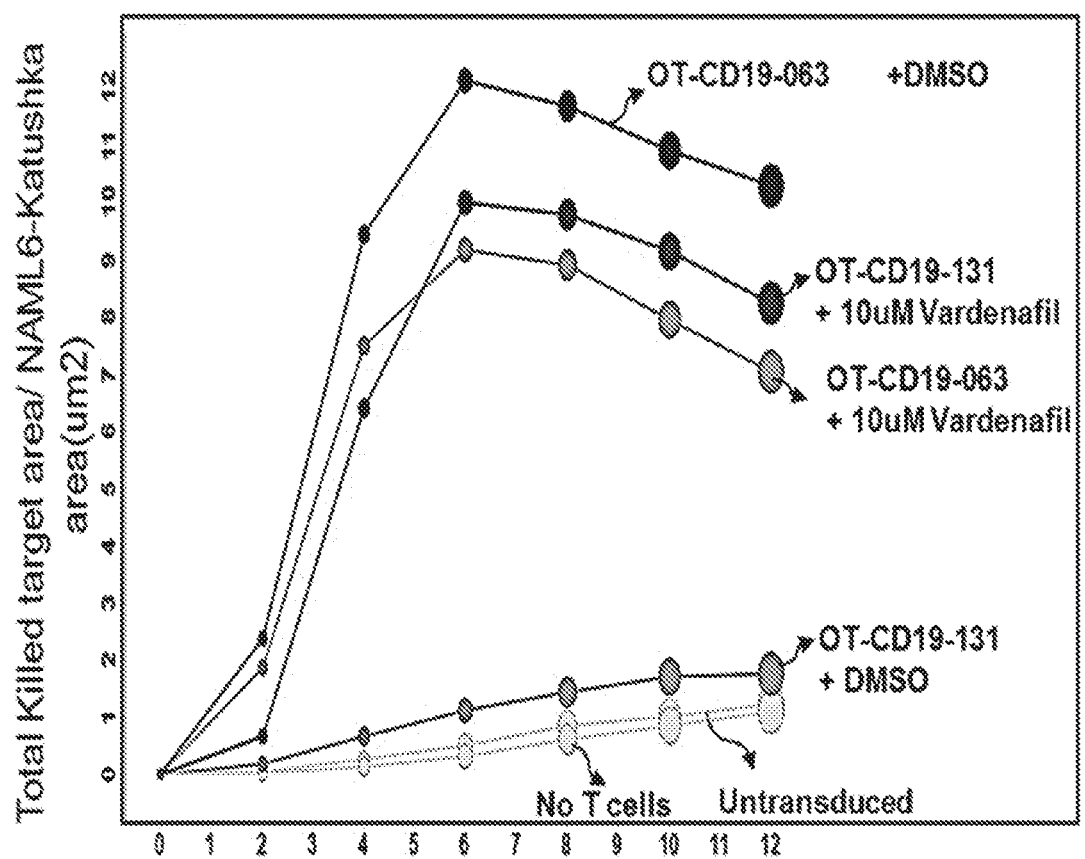
FIG. 19J shows the target cell killing by CAR expressing T cells in the presence of vardenafil.
Figure 19K:
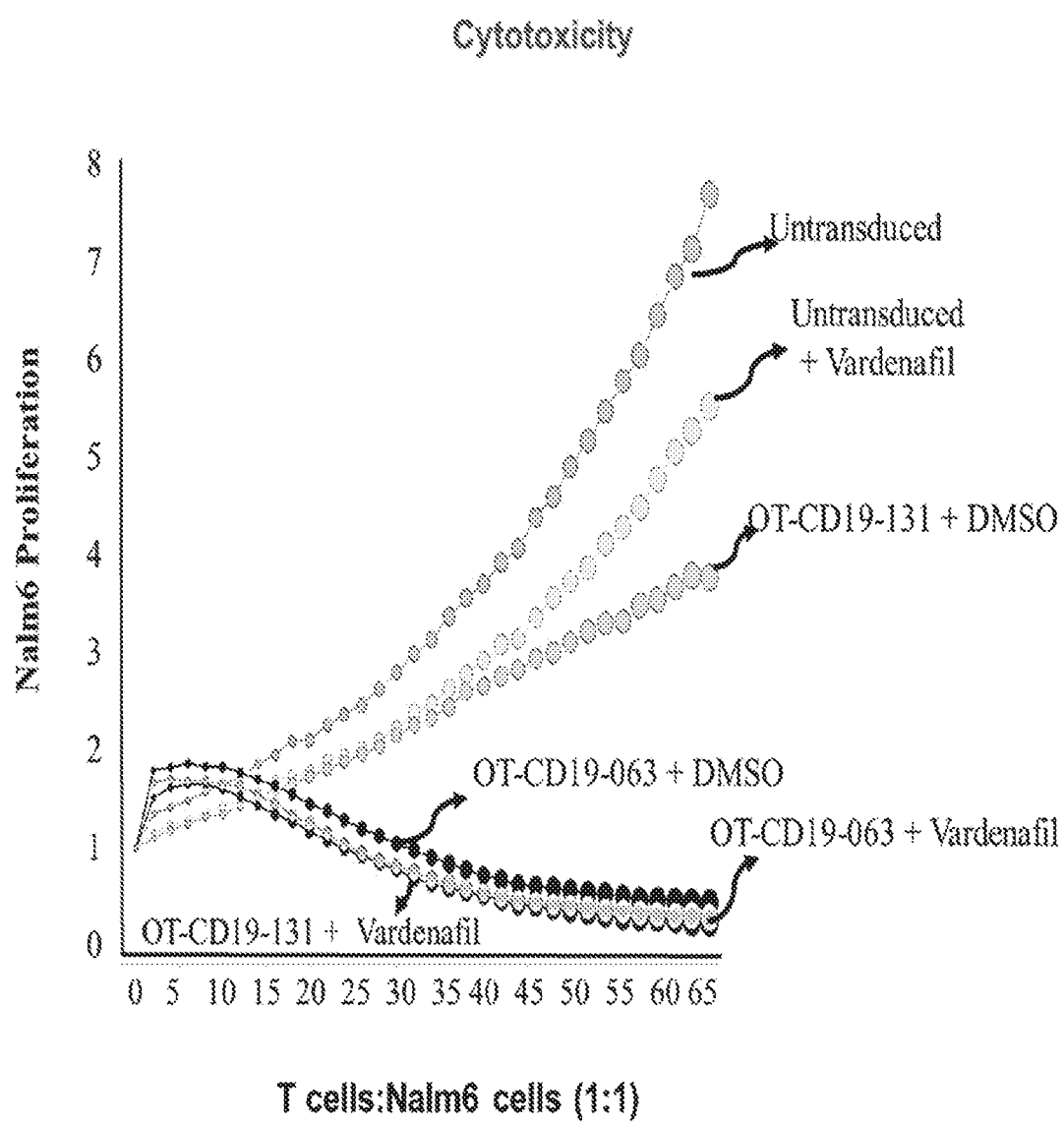
FIG. 19K shows the proliferation of target cells cocultured with CAR expressing T cells in the presence of vardenafil.

The functionality of the CAR transduced T cells was also tested in vitro. T cells were transduced with OT-CD19-131 or the constitutive construct OT-CD19-063. Cells were then frozen. Prior to the experiment, T cells were thawed overnight, and cocultured with Nalm6 target cells stably expressing Katushka RFP. Nalm6 cells express high levels of CD19 antigen and are hence ideal target cells in cell killing assay that test CD19 CAR constructs. T cells were mixed with Nalm6 cells at an effector cell to target cell (E:T) ratio of 5:1 for 12 hours in the presence of 10 µM vardenafil or DMSO. Target cell apoptosis was determined by measuring Annexin V fluorescence over time using the Incucyte instrument. Cell killing is measured as the ratio of the total killed target area and to the NALM6-Katushka area ($\mu M^2$). As shown in FIG. 19J, the total killed target cell area increased when Nalm6 cells were co-cultured with OT-CD19-131 expressing T cells in the presence of vardenafil. Similar trend was observed in the proliferation of Nalm6 cells (FIG. 19K). The same cells did not result in significant cell killing in presence of DMSO, showing that the target cell killing by the T cells is specifically in response to the presence of the ligand. As expected, the constitutive construct, OT-CD19-063 showed increased total killed target cell area both in the presence and absence of ligand, with a trend towards more killing in the presence of the ligand. Nalm6 cells co-cultured with untransduced T cells and Nalm6 cells that were not co-cultured with T cells did not show an increase in the total killed target area. Taken together, these data show that the regulated CAR construct, OT-CD19-131 is active on antigen positive cells only in response to ligand.

The cell supernatants were also collected from the T cell/Nalm6 cytotoxicity co-culture assays at 66 hours and Interferon gamma levels were measured by MSD assays. The results are shown in Table 45G.

TABLE 45G

| Construct | Interferon gamma production (pg/mL) | |
| --- | --- | --- |
| | DMSO | Vardenafil 10 µM |
| OT-CD19-131 | 443.99 | 2282.98 |
| OT-CD19-063 | 3268.72 | 1980.48 |
| Untransduced | 16.57 | 18.48 |

As shown in Table 45G, the interferon gamma levels showed a five-fold induction in OT-CD19-131 transduced T cells with the addition of vardenafil. Vardenafil treatment did not induce interferon gamma production in OT-CD19-063 transduced T cells or untransduced T cells, indicating that the ligand specific induction of interferon gamma is related to the increased CAR expression and cell killing observed under similar conditions. The interferon gamma levels in DMSO treated OT-CD19-131 was lower than the levels observed with the constitutive construct indicating that the OT-CD19-131 cells have low basal expression of the CD19 CAR.

Example 26. In Vivo Assessment of hPDE5-Regulated CD19 CAR

Figure 20A:
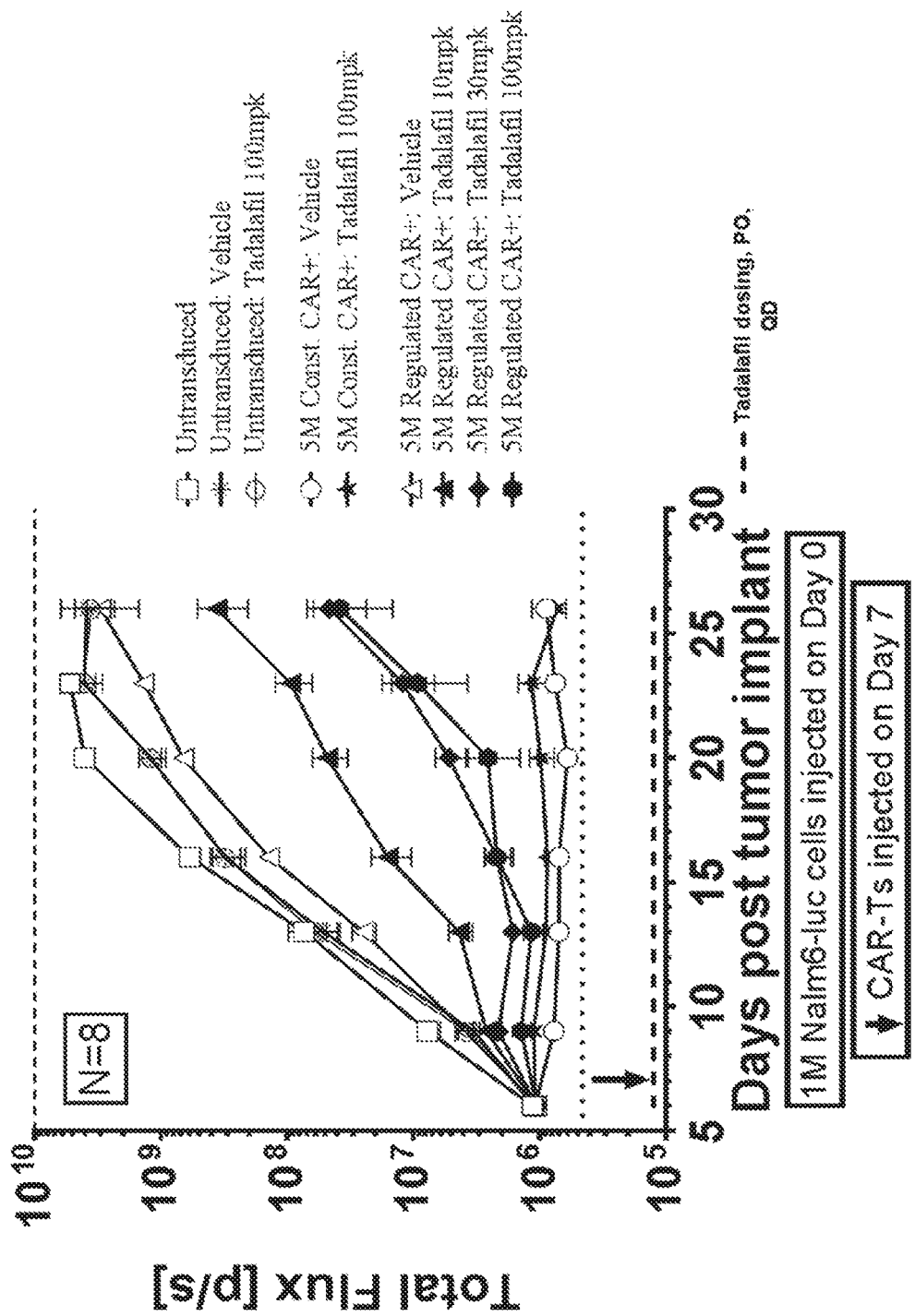
FIG. 20A shows the total flux of Nalm6 luc cells in mice, in the presence of tadalafil.
Figure 20B:
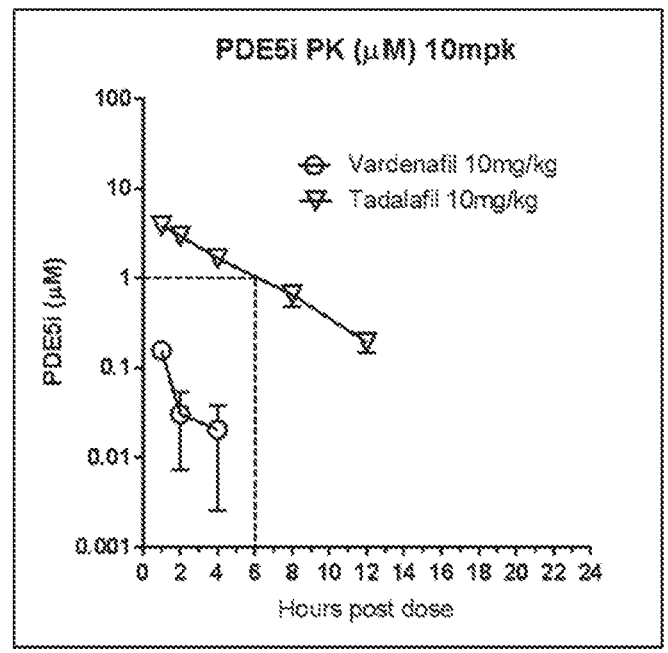
FIG. 20B and FIG. 20C show the pharmacokinetics of vardenafil and tadalafil in plasma of mice after injections of ligand at indicated doses.
Figure 20C:
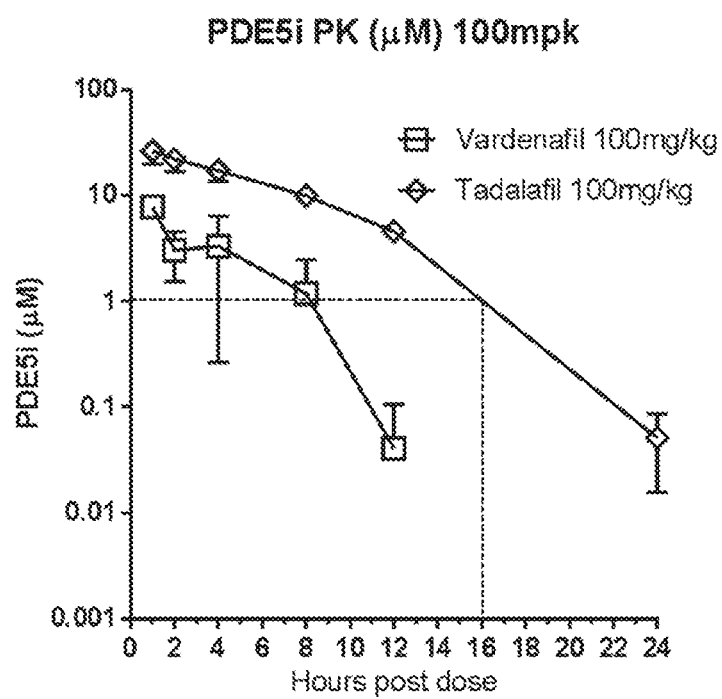

To test the efficacy of ligand regulated CAR efficacy in a tumor rejection model, 5 million CAR positive T cells (25 million total T cells) were injected in Nalm6 tumor bearing female NSG mice. The Nalm6-Luc is a B-cell precursor leukemia cell line used to generate an intravenous disseminated tumor model for studying blood tumors. Mice were treated daily with vehicle or Tadalafil at the following mg/kg body weight or mpk: 10 mpk, 30 mpk, or 100 mpk. Constitutive OT-CD19-063 transduced T cells served as a positive control and untransduced T cells as a negative control. T cells were injected 7 days after the Nalm6 cells were implanted. Animals in the Tadalafil groups received 2 doses of ligand prior to T cells being injected. The objective of the study was to test the ligand dose response regulation of a hPDE5 DD CD19 CAR-T and its impact on efficacy. Further, the study was also used to address if the presence of antigen was necessary for detection and expression of the CAR. Dose groups included (a) untransduced T cells (b) untransduced vehicle treated cells (c) Un-transduced cells dosed with Tadalafil 100 mg/kg (d) 5.0 Million CD19+ OT-CD19-063 CAR T cells (e) 5.0 Million CD19 positive Nalm6 cells with OT-CD19-063 CAR T cells (Vehicle) (f) 5.0 Million CD19 positive Nalm6 cells with OT-CD19-063 CAR T cells (Tadalafil 100 mg) (g) 5.0 Million CD19 positive Nalm6 cells with OT-CD19-131 CAR T cells (Vehicle) (h) 5.0 Million CD19 positive Nalm6 cells with OT-CD19-131 (Tadalafil 10 mg/kg) (i) 5.0 Million CD19 positive Nalm6 cells with OT-CD19-131 CAR T cells (Tadalafil 30 mg/kg) (j) 5.0 Million CD19 positive Nalm6 cells with OT-CD19-131 CAR T cells (Tadalafil 100 mg/kg). All animals were dosed once a day, orally for 25 days. Tumor burden assessments were made biweekly using bio luminescent imaging and the fluorescence intensity of Nalm6 Luc cells was observed over time. Two terminal collections were made to assess bone marrow, blood and spleen cell populations. Reduction in tumor burden/prevalence was measured by decreased luminescence from Nalm6-Luciferase cells, and was observed in Tadalafil treated CD19-131 animals (FIG. 20A). In FIG. 20A, "const" refers to OT-CD19-063 and "regulated" refers to OT-CD19-131. Taken together these data show that daily oral dosing of tadalafil resulted in dose-dependent suppression of tumor growth and/or reduction in tumor burden. Maximal tumor suppression was comparable to constitutive CAR with very low activity in the absence of drug. Plasma PK was also established in non-tumor-bearing mice of the hPDE5 inhibitors Tadalafil and Vardenafil after a single dose at the indicated dose levels and is shown in FIG. 20B and FIG. 20C.

SEQUENCE LISTING (8382 sequences)

SEQ ID NO: 1 - protein, 875 aa, Homo sapiens
MERAGPSFGQQRQQQQPQQQKQQQRDQDSVEAWLDDHWDFTFSYFVRKATREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 2 - DNA, 2628 bp, Homo sapiens
atggagcgggccggccccagcttcgggcagcagcgacagcagcagcagccccagcagcagaagcagcagcagagggatcaggactcggtcgaagcatggctggacgatcactgggactttaccttctcatactttgttagaaaagccaccagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactga

SEQ ID NO: 3 - protein, 326 aa, Homo sapiens
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 4 - DNA, 981 bp, Artificial Sequence
  Description of Artificial Sequence: Synthetic Construct
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 5 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKFQALAEQQ

SEQ ID NO: 6 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFADAICLQLYEALTHVSEDCFPLLDGCRKNRQKWQALAEQQ

SEQ ID NO: 7 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLAEALTHVSEDCFPLLDGCRKNRQKWQALAEQQ

SEQ ID NO: 8 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFADQGDRERKELNIEPTDLMNREKKNKIPSMQVGFIDAICLQLYEALTHVSEDCFPLLDGCRKNRQKWQALAEQQ

SEQ ID NO: 9 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 10 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLLHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 11 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALLIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 12 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 13 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCIFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 14 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaattccaggcccttgcagaacagcag

SEQ ID NO: 15 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcgccgatgccatctgcttgcaactgtatgaggccctgacccacgtgtcagaggactgtttccctttgctagatggctgcagaaagaacaggcagaaatggcaggcccttgcagaacagcag

SEQ ID NO: 16 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactggccgaggccctgacccacgtgtcagaggactgtttccctttgctagatggctgcagaaagaacaggcagaaatggcaggcccttgcagaacagcag

SEQ ID NO: 17 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaatttgccgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 18 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgccgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 19 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttgctgcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 20 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgctgattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 21 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 22 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatctttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 23 - protein, 326 aa, Artificial Sequence
  Description of Artificial Sequence: Synthetic Destabilizing Domain (DD)
DETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 24 - protein, 326 aa, Artificial Sequence
  Description of Artificial Sequence: Synthetic Destabilizing Domain (DD)
EGTRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 25 - protein, 326 aa, Artificial Sequence
  Description of Artificial Sequence: Synthetic Destabilizing Domain (DD)
EETRELRSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 26 - protein, 326 aa, Artificial Sequence
  Description of Artificial Sequence: Synthetic Destabilizing Domain (DD)
EETRELQSLAAAVVPSAQTLRITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 27 - protein, 326 aa, Artificial Sequence
  Description of Artificial Sequence: Synthetic Destabilizing Domain (DD)
EETRELQSLAAAVVPSAQTLKITDLSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 28 - protein, 326 aa, Artificial Sequence
  Description of Artificial Sequence: Synthetic Destabilizing Domain (DD)
EETRELQSLAAAVVPSAQTLKITDFSLSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 29 - protein, 326 aa, Artificial Sequence
  Description of Artificial Sequence: Synthetic Destabilizing Domain (DD)
EETRELQSLAAAVVPSAQTLKITDFSFSDLELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 30 - protein, 326 aa, Artificial Sequence
  Description of Artificial Sequence: Synthetic Destabilizing Domain (DD)
EETRELQSLAAAVVPSAQTLKITDFSFSDSELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 31 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMEHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 32 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQSFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 33 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKENYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 34 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRENVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 35 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKHVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 36 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALRAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 37 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGEIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 38 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQSKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 39 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVSNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 40 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLDCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 41 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLNCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 42 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYRHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 43 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCRSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 44 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFAQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 45 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTSLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 46 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATNLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 47 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATGLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 48 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFEHIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 49 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKSQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 50 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTSCDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 51 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 52 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACGLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 53 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACVLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 54 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLFAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 55 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDREREELNIEPTDLMNREKKNKIPSMQVGFIDAICLQLYEALTHVSEDCFPLLDGCRKNRQKWQALAEQQ

SEQ ID NO: 56 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKEFNIEPTDLMNREKKNKIPSMQVGFIDAICLQLYEALTHVSEDCFPLLDGCRKNRQKWQALAEQQ

SEQ ID NO: 57 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNTEPTDLMNREKKNKIPSMQVGFIDAICLQLYEALTHVSEDCFPLLDGCRKNRQKWQALAEQQ

SEQ ID NO: 58 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPPDLMNREKKNKIPSMQVGFIDAICLQLYEALTHVSEDCFPLLDGCRKNRQKWQALAEQQ

SEQ ID NO: 59 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPCMQVGFIDAICLQLYEALTHVSEDCFPLLDGCRKNRQKWQALAEQQ

SEQ ID NO: 60 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSAQVGFIDAICLQLYEALTHVSEDCFPLLDGCRKNRQKWQALAEQQ

SEQ ID NO: 61 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDATCLQLYEALTHVSEDCFPLLDGCRKNRQKWQALAEQQ

SEQ ID NO: 62 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDSFPLLDGCRKNRQKWQALAEQQ

SEQ ID NO: 63 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQEWQALAEQQ

SEQ ID NO: 64 - protein, 326 aa, Artificial Sequence
  Description of Artificial Sequence: Synthetic Destabilizing Domain (DD)
EETRELQSLAAAVVPSAQTLKITDFGFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 65 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLAQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 66 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWVLSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 67 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLVAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 68 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNPYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 69 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQPYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 70 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKATLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 71 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQLNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 72 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNSEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 73 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELLLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 74 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDPMNREKKNKIPSMQVGFIDAICLQLYEALTHVSEDCFPLLDGCRKNRQKWQALAEQQ

SEQ ID NO: 75 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSTQVGFIDAICLQLYEALTHVSEDCFPLLDGCRKNRQKWQALAEQQ

SEQ ID NO: 76 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCSPLLDGCRKNRQKWQALAEQQ

SEQ ID NO: 77 - protein, 9 aa, Artificial Sequence
  Description of Artificial Sequence: Synthetic Linker
GGSGGGSGG

SEQ ID NO: 78 - protein, 6 aa, Artificial Sequence
  Description of Artificial Sequence: Synthetic Linker
GGSGGG

SEQ ID NO: 79 - protein, 238 aa, Aequorea coerulescens
VSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 80 - protein, 574 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQGGSGGGSGGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 81 - protein, 574 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKFQALAEQQGGSGGGSGGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 82 - protein, 574 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFADAICLQLYEALTHVSEDCFPLLDGCRKNRQKWQALAEQQGGSGGGSGGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 83 - protein, 574 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLAEALTHVSEDCFPLLDGCRKNRQKWQALAEQQGGSGGGSGGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 84 - protein, 574 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFADQGDRERKELNIEPTDLMNREKKNKIPSMQVGFIDAICLQLYEALTHVSEDCFPLLDGCRKNRQKWQALAEQQGGSGGGSGGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 85 - protein, 574 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQGGSGGGSGGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 86 - protein, 574 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLLHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQGGSGGGSGGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 87 - protein, 574 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALLIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQGGSGGGSGGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 88 - protein, 574 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQGGSGGGSGGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 89 - protein, 574 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCIFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQGGSGGGSGGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 90 - protein, 571 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQGGSGGGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 91 - protein, 567 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 92 - DNA, 27 bp, Artificial Sequence
  Description of Artificial Sequence: Synthetic Linker
ggaggtagtggtggaggcagtggtgga

SEQ ID NO: 93 - DNA, 18 bp, Artificial Sequence
  Description of Artificial Sequence: Synthetic Linker
ggtggctctggtggtggt

SEQ ID NO: 94 - DNA, 717 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaa

SEQ ID NO: 95 - DNA, 1725 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggaggtagtggtggaggcagtggtggagtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 96 - DNA, 1725 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaattccaggcccttgcagaacagcagggaggtagtggtggaggcagtggtggagtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 97 - DNA, 1725 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcgccgatgccatctgcttgcaactgtatgaggccctgacccacgtgtcagaggactgtttccctttgctagatggctgcagaaagaacaggcagaaatggcaggcccttgcagaacagcagggaggtagtggtggaggcagtggtggagtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 98 - DNA, 1725 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactggccgaggccctgacccacgtgtcagaggactgtttccctttgctagatggctgcagaaagaacaggcagaaatggcaggcccttgcagaacagcagggaggtagtggtggaggcagtggtggagtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 99 - DNA, 1725 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaatttgccgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggaggtagtggtggaggcagtggtggagtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 100 - DNA, 1725 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgccgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggaggtagtggtggaggcagtggtggagtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 101 - DNA, 1725 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttgctgcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggaggtagtggtggaggcagtggtggagtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 102 - DNA, 1725 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgctgattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggaggtagtggtggaggcagtggtggagtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 103 - DNA, 1725 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggaggtagtggtggaggcagtggtggagtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 104 - DNA, 1725 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatctttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggaggtagtggtggaggcagtggtggagtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 105 - DNA, 1716 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggaggtagtggtggaggcgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 106 - DNA, 1704 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 107 - protein, 519 aa, Homo sapiens
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 108 - protein, 323 aa, Homo sapiens
FKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERW

SEQ ID NO: 109 - protein, 536 aa, Homo sapiens
MELSPRSPPEMLEESDCPSPLELKSAPSKKMWIKLRSLLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 110 - protein, 300 aa, Homo sapiens
FKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKW

SEQ ID NO: 111 - protein, 709 aa, Homo sapiens
MESPTKEIEEFESNSLKYLQPEQIEKIWLRLRGLRKYKKTSQRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDGTKQRSHGSPAPSTSSTCRLTLPVIKPPLRHFKRPAYASSSYAPSVSKKTDEHPARYKMLDQRIKMKKIQNISHNWNRK

SEQ ID NO: 112 - protein, 320 aa, Homo sapiens
FKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERW

SEQ ID NO: 113 - protein, 941 aa, Homo sapiens
MGQACGHSILCRSQQYPAARPAEPRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 114 - protein, 259 aa, Homo sapiens
KIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASN

SEQ ID NO: 115 - protein, 1141 aa, Homo sapiens
MAVPGDAARVRDKPVHSGVSQAPTAGRDCHHRADPASPRDSGCRGCWGDLVLQPLRSSRKLSSALCAGSLSFLLALLVRLVRGEVGCDLEQCKEAAAAEEEEAAPGAEGGVFPGPRGGAPGGGARLSPWLQPSALLFSLLCAFFWMGLYLLRAGVRLPLAVALLAACCGGEALVQIGLGVGEDHLLSLPAAGVVLSCLAAATWLVLRLRLGVLMIALTSAVRTVSLISLERFKVAWRPYLAYLAGVLGILLARYVEQILPQSAEAAPREHLGSQLIAGTKEDIPVFKRRRRSSSVVSAEMSGCSSKSHRRTSLPCIPREQLMGHSEWDHKRGPRGSQSSGTSITVDIAVMGEAHGLITDLLADPSLPPNVCTSLRAVSNLLSTQLTFQAIHKPRVNPVTSLSENYTCSDSEESSEKDKLAIPKRLRRSLPPGLLRRVSSTWTTTTSATGLPTLEPAPVRRDRSTSIKLQEAPSSSPDSWNNPVMMTLTKSRSFTSSYAISAANHVKAKKQSRPGALAKISPLSSPCSSPLQGTPASSLVSKISAVQFPESADTTAKQSLGSHRALTYTQSAPDLSPQILTPPVICSSCGRPYSQGNPADEPLERSGVATRTPSRTDDTAQVTSDYETNNNSDSSDIVQNEDETECLREPLRKASACSTYAPETMMFLDKPILAPEPLVMDNLDSIMEQLNTWNFPIFDLVENIGRKCGRILSQVSYRLFEDMGLFEAFKIPIREFMNYFHALEIGYRDIPYHNRIHATDVLHAVWYLTTQPIPGLSTVINDHGSTSDSDSDSGFTHGHMGYVFSKTYNVTDDKYGCLSGNIPALELMALYVAAAMHDYDHPGRTNAFLVATSAPQAVLYNDRSVLENHHAAAAWNLFMSRPEYNFLINLDHVEFKHFRFLVIEAILATDLKKHFDFVAKFNGKVNDDVGIDWTNENDRLLVCQMCIKLADINGPAKCKELHLQWTDGIVNEFYEQGDEEASLGLPISPFMDRSAPQLANLQESFISHIVGPLCNSYDSAGLMPGKWVEDSDESGDTDDPEEEEEEAPAPNEEETCENNESPKKKTFKRRKIYCQITQHLLQNHKMWKKVIEEEQRLAGIENQSLDQTPQSHSSEQIQAIKEEEEEKGKPRGEEIPTQKPDQ

SEQ ID NO: 116 - protein, 359 aa, Homo sapiens
FKIPIREFMNYFHALEIGYRDIPYHNRIHATDVLHAVWYLTTQPIPGLSTVINDHGSTSDSDSDSGFTHGHMGYVFSKTYNVTDDKYGCLSGNIPALELMALYVAAAMHDYDHPGRTNAFLVATSAPQAVLYNDRSVLENHHAAAAWNLFMSRPEYNFLINLDHVEFKHFRFLVIEAILATDLKKHFDFVAKFNGKVNDDVGIDWTNENDRLLVCQMCIKLADINGPAKCKELHLQWTDGIVNEFYEQGDEEASLGLPISPFMDRSAPQLANLQESFISHIVGPLCNSYDSAGLMPGKWVEDSDESGDTDDPEEEEEEAPAPNEEETCENNESPKKKTFKRRKIYCQITQHLLQNHKMW

SEQ ID NO: 117 - protein, 1112 aa, Homo sapiens
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 118 - protein, 360 aa, Homo sapiens
FKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIW

SEQ ID NO: 119 - protein, 886 aa, Homo sapiens
MEPPTVPSERSLSLSLPGPREGQATLKPPPQHLWRQPRTPIRIQQRGYSDSAERAERERQPHRPIERADAMDTSDRPGLRTTRMSWPSSFHGTGTGSGGAGGGSSRRFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 120 - protein, 394 aa, Homo sapiens
QPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISM

SEQ ID NO: 121 - protein, 736 aa, Homo sapiens
MKKSRSVMTVMADDNVKDYFECSLSKSYSSSSNTLGIDLWRGRRCCSGNLQLPPLSQRQSERARTPEGDGISRPTTLPLTTLPSIAITTVSQECFDVENGPSPGRSPLDPQASSSAGLVLHATFPGHSQRRESFLYRSDSDYDLSPKAMSRNSSLPSEQHGDDLIVTPFAQVLASLRSVRNNFTILTNLHGTSNKRSPAASQPPVSRVNPQEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 122 - protein, 353 aa, Homo sapiens
VNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFEL

SEQ ID NO: 123 - protein, 712 aa, Homo sapiens
MENLGVGEGAEACSRLSRSRGRHSMTRAPKHLWRQPRRPIRIQQRFYSDPDKSAGCRERDLSPRPELRKSRLSWPVSSCRRFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 124 - protein, 366 aa, Homo sapiens
VQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGE

SEQ ID NO: 125 - protein, 809 aa, Homo sapiens
MEAEGSSAPARAGSGEGSDSAGGATLKAPKHLWRHEQHHQYPLRQPQFRLLHPHHHLPPPPPPSPQPQPQCPLQPPPPPPLPPPPPPPGAARGRYASSGATGRVRHRGYSDTERYLYCRAMDRTSYAVETGHRPGLKKSRMSWPSSFQGLRRFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 126 - protein, 366 aa, Homo sapiens
VKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKD

SEQ ID NO: 127 - protein, 860 aa, Homo sapiens
MGEVTAEEVEKFLDSNIGFAKQYYNLHYRAKLISDLLGAKEAAVDFSNYHSPSSMEESEIIFDLLRDFQENLQTEKCIFNVMKKLCFLLQADRMSLFMYRTRNGIAELATRLFNVHKDAVLEDCLVMPDQEIVFPLDMGIVGHVAHSKKIANVPNTEEDEHFCDFVDILTEYKTKNILASPIMNGKDVVAIIMAVNKVDGSHFTKRDEEILLKYLNFANLIMKVYHLSYLHNCETRRGQILLWSGSKVFEELTDIERQFHKALYTVRAFLNCDRYSVGLLDMTKQKEFFDVWPVLMGEVPPYSGPRTPDGREINFYKVIDYILHGKEDIKVIPNPPPDHWALVSGLPAYVAQNGLICNIMNAPAEDFFAFQKEPLDESGWMIKNVLSMPIVNKKEEIVGVATFYNRKDGKPFDEMDETLMESLTQFLGWSVLNPDTYESMNKLENRKDIFQDIVKYHVKCDNEEIQKILKTREVYGKEPWECEEEELAEILQAELPDADKYEINKFHFSDLPLTELELVKCGIQMYYELKVVDKFHIPQEALVRFMYSLSKGYRKITYHNWRHGFNVGQTMFSLLVTGKLKRYFTDLEALAMVTAAFCHDIDHRGTNNLYQMKSQNPLAKLHGSSILERHHLEFGKTLLRDESLNIFQNLNRRQHEHAIHMMDIAIIATDLALYFKKRTMFQKIVDQSKTYESEQEWTQYMMLEQTRKEIVMAMMMTACDLSAITKPWEVQSQVALLVAAEFWEQGDLERTVLQQNPIPMMDRNKADELPKLQVGFIDFVCTFVYKEFSRFHEEITPMLDGITNNRKEWKALADEYDAKMKVQEEKKQKQQSAKSAAAGNQPGGNPSPGGATTSKSCCIQ

SEQ ID NO: 128 - protein, 337 aa, Homo sapiens
EEEELAEILQAELPDADKYEINKFHFSDLPLTELELVKCGIQMYYELKVVDKFHIPQEALVRFMYSLSKGYRKITYHNWRHGFNVGQTMFSLLVTGKLKRYFTDLEALAMVTAAFCHDIDHRGTNNLYQMKSQNPLAKLHGSSILERHHLEFGKTLLRDESLNIFQNLNRRQHEHAIHMMDIAIIATDLALYFKKRTMFQKIVDQSKTYESEQEWTQYMMLEQTRKEIVMAMMMTACDLSAITKPWEVQSQVALLVAAEFWEQGDLERTVLQQNPIPMMDRNKADELPKLQVGFIDFVCTFVYKEFSRFHEEITPMLDGITNNRKEWKALADEYDAK

SEQ ID NO: 129 - protein, 854 aa, Homo sapiens
MSLSEEQARSFLDQNPDFARQYFGKKLSPENVAAACEDGCPPDCDSLRDLCQVEESTALLELVQDMQESINMERVVFKVLRRLCTLLQADRCSLFMYRQRNGVAELATRLFSVQPDSVLEDCLVPPDSEIVFPLDIGVVGHVAQTKKMVNVEDVAECPHFSSFADELTDYKTKNMLATPIMNGKDVVAVIMAVNKLNGPFFTSEDEDVFLKYLNFATLYLKIYHLSYLHNCETRRGQVLLWSANKVFEELTDIERQFHKAFYTVRAYLNCERYSVGLLDMTKEKEFFDVWSVLMGESQPYSGPRTPDGREIVFYKVIDYVLHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 130 - protein, 341 aa, Homo sapiens
PADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAK

SEQ ID NO: 131 - protein, 858 aa, Homo sapiens
MGEINQVAVEKYLEENPQFAKEYFDRKLRVEVLGEIFKNSQVPVQSSMSFSELTQVEESALCLELLWTVQEEGGTPEQGVHRALQRLAHLLQADRCSMFLCRSRNGIPEVASRLLDVTPTSKFEDNLVGPDKEVVFPLDIGIVGWAAHTKKTHNVPDVKKNSHFSDFMDKQTGYVTKNLLATPIVVGKEVLAVIMAVNKVNASEFSKQDEEVFSKYLNFVSIILRLHHTSYMYNIESRRSQILMWSANKVFEELTDVERQFHKALYTVRSYLNCERYSIGLLDMTKEKEFYDEWPIKLGEVEPYKGPKTPDGREVNFYKIIDYILHGKEEIKVIPTPPADHWTLISGLPTYVAENGFICNMMNAPADEYFTFQKGPVDETGWVIKNVLSLPIVNKKEDIVGVATFYNRKDGKPFDEHDEYITETLTQFLGWSLLNTDTYDKMNKLENRKDIAQEMLMNQTKATPEEIKSILKFQEKLNVDVIDDCEEKQLVAILKEDLPDPRSAELYEFRFSDFPLTEHGLIKCGIRLFFEINVVEKFKVPVEVLTRWMYTVRKGYRAVTYHNWRHGFNVGQTMFTLLMTGRLKKYYTDLEAFAMLAAAFCHDIDHRGTNNLYQMKSTSPLARLHGSSILERHHLEYSKTLLQDESLNIFQNLNKRQFETVIHLFEVAIIATDLALYFKKRTMFQKIVDACEQMQTEEEAIKYVTVDPTKKEIIMAMMMTACDLSAITKPWEVQSQVALMVANEFWEQGDLERTVLQQQPIPMMDRNKRDELPKLQVGFIDFVCTFVYKEFSRFHKEITPMLSGLQNNRVEWKSLADEYDAKMKVIEEEAKKQEGGAEKAAEDSGGGDDKKSKTCLML

SEQ ID NO: 132 - protein, 340 aa, Homo sapiens
DDCEEKQLVAILKEDLPDPRSAELYEFRFSDFPLTEHGLIKCGIRLFFEINVVEKFKVPVEVLTRWMYTVRKGYRAVTYHNWRHGFNVGQTMFTLLMTGRLKKYYTDLEAFAMLAAAFCHDIDHRGTNNLYQMKSTSPLARLHGSSILERHHLEYSKTLLQDESLNIFQNLNKRQFETVIHLFEVAIIATDLALYFKKRTMFQKIVDACEQMQTEEEAIKYVTVDPTKKEIIMAMMMTACDLSAITKPWEVQSQVALMVANEFWEQGDLERTVLQQQPIPMMDRNKRDELPKLQVGFIDFVCTFVYKEFSRFHKEITPMLSGLQNNRVEWKSLADEYDAK

SEQ ID NO: 133 - protein, 482 aa, Homo sapiens
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 134 - protein, 265 aa, Homo sapiens
FHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASW

SEQ ID NO: 135 - protein, 450 aa, Homo sapiens
MSCLMVERCGEILFENPDQNAKCVCMLGDIRLRGQTGVRAERRGSYPFIDFRLLNSTTYSGEIGTKKKVKRLLSFQRYFHASRLLRGIIPQAPLHLLDEDYLGQARHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQNMSVLENHHWRSTIGMLRESRLLAHLPKEMTQDIEQQLGSLILATDINRQNEFLTRLKAHLHNKDLRLEDAQDRHFMLQIALKCADICNPCRIWEMSKQWSERVCEEFYRQGELEQKFELEISPLCNQQKDSIPSIQIGFMSYIVEPLFREWAHFTGNSTLSENMLGHLAHNKAQWKSLLPRQHRSRGSSGSGPDHDHAGQGTESEEQEGDSP

SEQ ID NO: 136 - protein, 239 aa, Homo sapiens
YHNAVHAADVTQAMHCYLKEPKLASFLTPLDIMLGLLAAAAHDVDHPGVNQPFLIKTNHHLANLYQNMSVLENHHWRSTIGMLRESRLLAHLPKEMTQDIEQQLGSLILATDINRQNEFLTRLKAHLHNKDLRLEDAQDRHFMLQIALKCADICNPCRIWEMSKQWSERVCEEFYRQGELEQKFELEISPLCNQQKDSIPSIQIGFMSYIVEPLFREWAHFTGNSTLSENMLGHLAHNK

SEQ ID NO: 137 - protein, 829 aa, Homo sapiens
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 138 - protein, 283 aa, Homo sapiens
LHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYW

SEQ ID NO: 139 - protein, 885 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 140 - protein, 279 aa, Homo sapiens
LNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHW

SEQ ID NO: 141 - protein, 593 aa, Homo sapiens
MGSGSSSYRPKAIYLDIDGRIQKVIFSKYCNSSDIMDLFCIATGLPRNTTISLLTTDDAMVSIDPTMPANSERTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 142 - protein, 263 aa, Homo sapiens
FSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRY

SEQ ID NO: 143 - protein, 779 aa, Homo sapiens
MRIEERKSQHLTGLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 144 - protein, 302 aa, Homo sapiens
CKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEE

SEQ ID NO: 145 - protein, 933 aa, Homo sapiens
MAASRLDFGEVETFLDRHPELFEDYLMRKGKQEMVEKWLQRHSQGQGALGPRPSLAGTSSLAHSTCRGGSSVGGGTGPNGSAHSQPLPGGGDCGGVPLSPSWAGGSRGDGNLQRRASQKELRKSFARSKAIHVNRTYDEQVTSRAQEPLSSVRRRALLRKASSLPPTTAHILSALLESRVNLPRYPPTAIDYKCHLKKHNERQFFLELVKDISNDLDLTSLSYKILIFVCLMVDADRCSLFLVEGAAAGKKTLVSKFFDVHAGTPLLPCSSTENSNEVQVPWGKGIIGYVGEHGETVNIPDAYQDRRFNDEIDKLTGYKTKSLLCMPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 146 - protein, 266 aa, Homo sapiens
FKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKW

SEQ ID NO: 147 - protein, 833 aa, Homo sapiens
MLPFGDKTREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 148 - DNA, 6836 bp, Homo sapiens
tggttctgagtcgccgacctcacctcacctcacctgcgcgcgttgttgcccctacggagcctcctggagtccaggatcggcggagttcgaaaacgaacttcccacgtttgctatgttgccctttggagacaaaacaagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctattttatttctttgttggatattttagttcatacaaagcagagtacttctttagggctggttaattggttcaaataatttttaatttcctttctagtatcttctcaagttggaaaaatatacatacagtcctccttcaccttactctgtatttatattacccataactagcaagaagttcttgttctagattttttgtttgtttagttataacagagtaacataccatttaattacaatttttagccagaaaagtccccactattttactaacttgttaaaagatatctatataattgcctggccttatatttttcagtagattagaccgtgccaatcacaatcctgggtggatttgtgtaagtcacttaacctctgtgtgcctaaacaagttgtgcttttttaaaaggagttatgtttgggcaaagcctttgtcttcaagcagaatgtcacagaaggcagctactttataagccccaatgggccatggagaccactgtcagaaatgggatattagtctagagagaaggtgatctattcccacatgtcatttctaatgttgagtttccatgactgaacaaagagaatatatttattcagcttcacttgcagatcactagtgaatgtgagatttagagctcattgagtatattgcttcaaggtacaaacccaggatgatgatgttgtcaccactgtctcttaattttgaataatagtttcctttaataggagtattagagataagaaagtatatgaaaatatactggaaatattggattcttggagaaaactgttcagtcacagatatattcttgcctagcagtgaagtgcctttattttcagcatagcaaataaatattagacctgttccaatttgatctacaatttttttctgtgtttttcaccagattgtactcctaaaacttaacaggccatcacaagcaattgtcttttgtttacaagattgatttaatatgagaggatacaaaatgtcatcgttatcctctcttatgaacaactgtagtcaaaataaggtggcacaatttaattgttttgtatcagaaatacactgacccaccttttattgagtcctgccacatgttaggtaccgtgctctgctgtggagacagagcagtgaccccaaggagctcacggtccctgaaggaggtgctagagaagagacttagcttctgatactgccaatttaatgtgagaacatggggtatactgcatcatttccattttcatcaataacatatgttttatgcaccttctttacctgaaacttactaagaatctaccagtaaacaaacatcctgtctttttgcaagtatgaatcacttaacctgctgatagttgaagaacactttaggagttttgtattcttgtatatagtttattttttccatgtgctagccaggtaaagattacacagttcttctggactgttaaattgtgcatggttttggaccccttctgctctactacagagagtgaagaagaaagtattaaagctcactttaccattccatatacttactaaaagcctgtgtaaacatgtcttaatgaatgttgttgaaagcaatgtaaatagttgaaaatataaatttatattacagtttaagaaaaccttatgaggcatcactagccactgttaatatctatttgtattcttataccttttcaatatatttgaacaaatatagtttctggcactatttttatactaggaaaaggagttactatgtatattatgcttagcttttaaggcattttaaataaccatgaatgttgatttcattactttcctttcctccatcacgagagtcatttcagatgactctttcatgacaaaatcactttaaaggaacacttacctccgattcctgtataaagtcatgagatggtcaaggtggttttccattgtgcaaattcttcacctgtcagtggtttcctcattttgccatgctttgtaaaaataaaaagaatgatcaagtaggtatgaaaaaaaaaaaaaaaaaa

SEQ ID NO: 149 - protein, 823 aa, Homo sapiens
MVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 150 - DNA, 6788 bp, Homo sapiens
cctcgccctggccctggctgggcggggaagctggggtgagggacgagtccacgggacagcccaaaggcaacatgacggaaccttgccaaaagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctattttatttctttgttggatattttagttcatacaaagcagagtacttctttagggctggttaattggttcaaataatttttaatttcctttctagtatcttctcaagttggaaaaatatacatacagtcctccttcaccttactctgtatttatattacccataactagcaagaagttcttgttctagattttttgtttgtttagttataacagagtaacataccatttaattacaatttttagccagaaaagtccccactattttactaacttgttaaaagatatctatataattgcctggccttatatttttcagtagattagaccgtgccaatcacaatcctgggtggatttgtgtaagtcacttaacctctgtgtgcctaaacaagttgtgcttttttaaaaggagttatgtttgggcaaagcctttgtcttcaagcagaatgtcacagaaggcagctactttataagccccaatgggccatggagaccactgtcagaaatgggatattagtctagagagaaggtgatctattcccacatgtcatttctaatgttgagtttccatgactgaacaaagagaatatatttattcagcttcacttgcagatcactagtgaatgtgagatttagagctcattgagtatattgcttcaaggtacaaacccaggatgatgatgttgtcaccactgtctcttaattttgaataatagtttcctttaataggagtattagagataagaaagtatatgaaaatatactggaaatattggattcttggagaaaactgttcagtcacagatatattcttgcctagcagtgaagtgcctttattttcagcatagcaaataaatattagacctgttccaatttgatctacaatttttttctgtgtttttcaccagattgtactcctaaaacttaacaggccatcacaagcaattgtcttttgtttacaagattgatttaatatgagaggatacaaaatgtcatcgttatcctctcttatgaacaactgtagtcaaaataaggtggcacaatttaattgttttgtatcagaaatacactgacccaccttttattgagtcctgccacatgttaggtaccgtgctctgctgtggagacagagcagtgaccccaaggagctcacggtccctgaaggaggtgctagagaagagacttagcttctgatactgccaatttaatgtgagaacatggggtatactgcatcatttccattttcatcaataacatatgttttatgcaccttctttacctgaaacttactaagaatctaccagtaaacaaacatcctgtctttttgcaagtatgaatcacttaacctgctgatagttgaagaacactttaggagttttgtattcttgtatatagtttattttttccatgtgctagccaggtaaagattacacagttcttctggactgttaaattgtgcatggttttggaccccttctgctctactacagagagtgaagaagaaagtattaaagctcactttaccattccatatacttactaaaagcctgtgtaaacatgtcttaatgaatgttgttgaaagcaatgtaaatagttgaaaatataaatttatattacagtttaagaaaaccttatgaggcatcactagccactgttaatatctatttgtattcttataccttttcaatatatttgaacaaatatagtttctggcactatttttatactaggaaaaggagttactatgtatattatgcttagcttttaaggcattttaaataaccatgaatgttgatttcattactttcctttcctccatcacgagagtcatttcagatgactctttcatgacaaaatcactttaaaggaacacttacctccgattcctgtataaagtcatgagatggtcaaggtggttttccattgtgcaaattcttcacctgtcagtggtttcctcattttgccatgctttgtaaaaataaaaagaatgatcaagtaggtatgaaaaaaaaaaaaaaaaaa

SEQ ID NO: 151 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRGGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 152 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRAGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 153 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRVGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 154 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRIGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 155 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRPGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 156 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRFGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 157 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRWGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 158 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRYGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 159 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRHGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 160 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRSGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 161 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRTGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 162 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRDGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 163 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKREGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 164 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRQGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 165 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRNGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 166 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRMGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 167 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRCGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 168 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRKGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 169 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggggcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 170 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 171 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggtgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 172 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggatcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 173 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggcccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 174 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggttcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 175 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggtggggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 176 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggtacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 177 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggcacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 178 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggagcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 179 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggaccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 180 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 181 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 182 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggcagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 183 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggaacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 184 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggatgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 185 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggtgcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 186 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggaagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 187 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRGGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 188 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRAGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 189 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRVGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 190 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRIGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 191 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRPGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 192 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRFGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 193 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRWGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 194 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRYGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 195 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRHGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 196 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRSGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 197 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRTGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 198 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRDGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 199 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKREGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 200 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRQGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 201 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRNGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 202 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRMGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 203 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRCGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 204 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRKGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 205 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggggcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 206 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 207 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggtgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 208 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggatcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 209 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggcccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 210 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggttcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 211 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggtggggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 212 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggtacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 213 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggcacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 214 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggagcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 215 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggaccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 216 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 217 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 218 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggcagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 219 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggaacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 220 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggatgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 221 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggtgcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 222 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggaagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 223 - protein, 550 aa, Artificial Sequence
  Description of Artificial Sequence: Synthetic polypeptide
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 224 - DNA, 1650 bp, Artificial Sequence
  Description of Artificial Sequence: Synthetic polynucleotide
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtg

SEQ ID NO: 225 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFAELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 226 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 227 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 228 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFAELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 229 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 230 - protein, 878 aa, Artificial Sequence
  Description of Artificial Sequence: Synthetic polypeptide
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAVSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 231 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgctgaacttataagaaaaaatcaattcaatttggaagatcctcatcaaaaggagttgtttttggcaatgctgatgacagcttgtaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 232 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 233 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 234 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgctgaacttataagaaaaaatcaattcaatttggaagatcctcatcaaaaggagttgtttttggcaatgctgatgacagcttgtaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 235 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 236 - DNA, 2637 bp, Artificial Sequence
  Description of Artificial Sequence: Synthetic polynucleotide
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 237 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 238 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 239 - protein, 303 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 240 - protein, 295 aa, Artificial Sequence
  Description of Artificial Sequence: Synthetic Destabilizing Domain (DD)
MSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 241 - protein, 271 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 242 - protein, 247 aa, Artificial Sequence
  Description of Artificial Sequence: Synthetic Destabilizing Domain (DD)
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 243 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 244 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 245 - protein, 543 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 246 - protein, 535 aa, Artificial Sequence
  Description of Artificial Sequence: Synthetic polypeptide
MSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 247 - protein, 511 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 248 - protein, 487 aa, Artificial Sequence
  Description of Artificial Sequence: Synthetic polypeptide
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 249 - skipped

SEQ ID NO: 250 - DNA, 981 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 251 - DNA, 909 bp, Artificial Sequence
  Description of Artificial Sequence: Synthetic Destabilizing Domain (DD)
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 252 - DNA, 885 bp, Artificial Sequence
  Description of Artificial Sequence: Synthetic Destabilizing Domain (DD)
atgagtgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 253 - DNA, 813 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 254 - DNA, 741 bp, Artificial Sequence
  Description of Artificial Sequence: Synthetic Destabilizing Domain (DD)
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 255 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 256 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 257 - DNA, 1632 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 258 - DNA, 1608 bp, Artificial Sequence
  Description of Artificial Sequence: Synthetic polynucleotide
atgagtgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 259 - DNA, 1536 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 260 - DNA, 1464 bp, Artificial Sequence
  Description of Artificial Sequence: Synthetic polynucleotide
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcaagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 261 - protein, 20 aa, Homo sapiens
MYRMQLLSCIALSLALVTNS

SEQ ID NO: 262 - DNA, 60 bp, Homo sapiens
atgtacaggatgcaactcctgtcttgcattgcactaagtcttgcacttgtcacaaacagt

SEQ ID NO: 263 - DNA, 60 bp, Artificial Sequence
  Description of Artificial Sequence: Synthetic Signal Sequence
atgtaccgaatgcaactgctgagctgcatcgccctgagcctggcactcgtgaccaacagc

SEQ ID NO: 264 - DNA, 60 bp, Artificial Sequence
  Description of Artificial Sequence: Synthetic Signal Sequence
atgtacaggatgcagctgctgagctgcatcgccctgagcctggccctggtgaccaacagc

SEQ ID NO: 265 - DNA, 60 bp, Artificial Sequence
  Description of Artificial Sequence: Synthetic Signal Sequence
atgtacagaatgcagctgctgagctgcatcgccctgtccctcgccctggtgaccaactcc

SEQ ID NO: 266 - protein, 22 aa, Homo sapiens
MCHQQLVISWFSLVFLASPLVA

SEQ ID NO: 267 - DNA, 66 bp, Homo sapiens
atgtgtcaccagcagttggtcatctcttggttttccctggtttttctggcatctcccctcgtggcc

SEQ ID NO: 268 - DNA, 66 bp, Artificial Sequence
  Description of Artificial Sequence: Synthetic Signal Sequence
atgtgccaccagcagctggtcatcagctggttctccctggtgtttctggcatcccctctggtggca

SEQ ID NO: 269 - DNA, 66 bp, Artificial Sequence
  Description of Artificial Sequence: Synthetic Signal Sequence
atgtgccaccagcagctggtcatcagctggttctccctggtgtttctggccagccctctggtggcc

SEQ ID NO: 270 - DNA, 66 bp, Artificial Sequence
  Description of Artificial Sequence: Synthetic Signal Sequence
atgtgccaccagcagctggtcatcagctggttctccctggtgtttctggcaagccctctggtggca

SEQ ID NO: 271 - DNA, 66 bp, Artificial Sequence
  Description of Artificial Sequence: Synthetic Signal Sequence
atgtgccaccagcagctggtcatcagctggttctccctggtgtttctggcatccccactggtggca

SEQ ID NO: 272 - DNA, 66 bp, Artificial Sequence
  Description of Artificial Sequence: Synthetic Signal Sequence
atgtgccaccaacagctcgtgatcagctggttctccctggtgttcctggctagccccctggtggcc

SEQ ID NO: 273 - DNA, 66 bp, Artificial Sequence
  Description of Artificial Sequence: Synthetic Signal Sequence
atgtgccaccagcagctggtcatctcttggttcagcctggtgtttctggcctcccccctggtggcc

SEQ ID NO: 274 - DNA, 66 bp, Artificial Sequence
  Description of Artificial Sequence: Synthetic Signal Sequence
atgtgccaccagcagctggtcatctcctggttctctctggtgtttctggcatctcctctggtggca

SEQ ID NO: 275 - DNA, 66 bp, Artificial Sequence
  Description of Artificial Sequence: Synthetic Signal Sequence
atgtgccaccagcagctggtcatctcttggttcagcctggtgtttctggcatccccactggtggca

SEQ ID NO: 276 - protein, 18 aa, Homo sapiens
MDWTWILFLVAAATRVHS

SEQ ID NO: 277 - DNA, 54 bp, Homo sapiens
atggactggacatggatactcttcctggtagcagccgccacacgagtgcacagc

SEQ ID NO: 278 - protein, 21 aa, Homo sapiens
MALPVTALLLPLALLLHAARP

SEQ ID NO: 279 - DNA, 63 bp, Homo sapiens
atggccttaccagtgaccgccttgctcctgccgctggccttgctgctccacgccgccaggccg

SEQ ID NO: 280 - DNA, 63 bp, Artificial Sequence
  Description of Artificial Sequence: Synthetic Signal Sequence
atggcactgcctgtgaccgccctgctgctgccactggccctgctgctgcacgcagccaggccc

SEQ ID NO: 281 - DNA, 63 bp, Artificial Sequence
  Description of Artificial Sequence: Synthetic Signal Sequence
atggcactgccagtgacagccctgctgctgcctctggccctgctgctgcacgcagccagacct

SEQ ID NO: 282 - DNA, 63 bp, Artificial Sequence
  Description of Artificial Sequence: Synthetic Signal Sequence
atggcactgcctgtgacagccctgctgctgccactggccctgctgctgcacgcagcccgccct

SEQ ID NO: 283 - DNA, 63 bp, Artificial Sequence
  Description of Artificial Sequence: Synthetic Signal Sequence
atggcactgcctgtgaccgccctgctgctgccactggccctgctgctgcacgcagcccgccct

SEQ ID NO: 284 - protein, 9 aa, Homo sapiens
SARNRQKRS

SEQ ID NO: 285 - DNA, 27 bp, Homo sapiens
agcgccaggaatcgccagaagcggtcc

SEQ ID NO: 286 - protein, 8 aa, Homo sapiens
ARNRQKRS

SEQ ID NO: 287 - DNA, 24 bp, Homo sapiens
gcccggaatagacagaagagatct

SEQ ID NO: 288 - protein, 12 aa, Artificial Sequence
  Description of Artificial Sequence: Synthetic Cleavage site sequence
ESRRVRRNKRSK

SEQ ID NO: 289 - DNA, 36 bp, Artificial Sequence
  Description of Artificial Sequence: Synthetic Cleavage site sequence
gagtctaggcgcgtgcggagaaataagcggagcaag

SEQ ID NO: 290 - DNA, 36 bp, Artificial Sequence
  Description of Artificial Sequence: Synthetic Cleavage site sequence
gagtctcggagagtgaggcgcaataagaggagcaag

SEQ ID NO: 291 - DNA, 36 bp, Artificial Sequence
  Description of Artificial Sequence: Synthetic Cleavage site sequence
gagtccaggagagtgcggcgcaacaagaggagcaag

SEQ ID NO: 292 - protein, 4 aa, Artificial Sequence
  Description of Artificial Sequence: Synthetic Linker
GGSG

SEQ ID NO: 293 - DNA, 12 bp, Artificial Sequence
  Description of Artificial Sequence: Synthetic Linker
ggaggatctgga

SEQ ID NO: 294 - protein, 5 aa, Artificial Sequence
  Description of Artificial Sequence: Synthetic Linker
GGSGG

SEQ ID NO: 295 - DNA, 15 bp, Artificial Sequence
  Description of Artificial Sequence: Synthetic Linker
ggaggcagcggagga

SEQ ID NO: 296 - DNA, 15 bp, Artificial Sequence
  Description of Artificial Sequence: Synthetic Linker
ggaggctctggagga

SEQ ID NO: 297 - DNA, 15 bp, Artificial Sequence
  Description of Artificial Sequence: Synthetic Linker
ggaggctccggcgga

SEQ ID NO: 298 - DNA, 15 bp, Artificial Sequence
  Description of Artificial Sequence: Synthetic Linker
ggaggatccggaggc

SEQ ID NO: 299 - DNA, 15 bp, Artificial Sequence
  Description of Artificial Sequence: Synthetic Linker
ggaggatctggagga

SEQ ID NO: 300 - DNA, 18 bp, Artificial Sequence
  Description of Artificial Sequence: Synthetic Linker
ggaggtagtggtggaggc

SEQ ID NO: 301 - protein, 5 aa, Artificial Sequence
  Description of Artificial Sequence: Synthetic Linker
SGGGS

SEQ ID NO: 302 - DNA, 15 bp, Artificial Sequence
  Description of Artificial Sequence: Synthetic Linker
tcaggtggcggtagt

SEQ ID NO: 303 - DNA, 15 bp, Artificial Sequence
  Description of Artificial Sequence: Synthetic Linker
agcggcggtggcagc

SEQ ID NO: 304 - protein, 5 aa, Artificial Sequence
  Description of Artificial Sequence: Synthetic Linker
GGGGG

SEQ ID NO: 305 - protein, 5 aa, Artificial Sequence
  Description of Artificial Sequence: Synthetic Linker
GGGGS

SEQ ID NO: 306 - protein, 10 aa, Artificial Sequence
  Description of Artificial Sequence: Synthetic Linker
GGGGSGGGGS

SEQ ID NO: 307 - protein, 15 aa, Artificial Sequence
  Description of Artificial Sequence: Synthetic Linker
GGGGSGGGGSGGGGS

SEQ ID NO: 308 - DNA, 45 bp, Artificial Sequence
  Description of Artificial Sequence: Synthetic Linker
ggaggaggaggatccggaggaggaggatctggcggcggcggcagc

SEQ ID NO: 309 - DNA, 45 bp, Artificial Sequence
  Description of Artificial Sequence: Synthetic Linker
ggaggaggaggatccggaggaggaggatctggcggaggaggcagc

SEQ ID NO: 310 - DNA, 45 bp, Artificial Sequence
  Description of Artificial Sequence: Synthetic Linker
ggaggaggaggaagcggaggaggaggatccggcggaggaggctct

SEQ ID NO: 311 - DNA, 45 bp, Artificial Sequence
  Description of Artificial Sequence: Synthetic Linker
ggaggaggaggcagcggaggaggaggttctggaggaggcggcagc

SEQ ID NO: 312 - DNA, 45 bp, Artificial Sequence
  Description of Artificial Sequence: Synthetic Linker
ggcggcggcggctctggaggaggaggcagcggcggaggaggctcc

SEQ ID NO: 313 - DNA, 45 bp, Artificial Sequence
  Description of Artificial Sequence: Synthetic Linker
ggaggaggaggcagcggcggaggaggctccggcggcggcggctct

SEQ ID NO: 314 - protein, 20 aa, Artificial Sequence
  Description of Artificial Sequence: Synthetic Linker
GGGGSGGGGSGGGGSGGGGS

SEQ ID NO: 315 - protein, 25 aa, Artificial Sequence
  Description of Artificial Sequence: Synthetic Linker
GGGGSGGGGSGGGGSGGGGSGGGGS

SEQ ID NO: 316 - protein, 30 aa, Artificial Sequence
  Description of Artificial Sequence: Synthetic Linker
GGGGSGGGGSGGGGSGGGGSGGGGSGGGGS

SEQ ID NO: 317 - protein, 5 aa, Artificial Sequence
  Description of Artificial Sequence: Synthetic Linker
SSSSG

SEQ ID NO: 318 - protein, 10 aa, Artificial Sequence
  Description of Artificial Sequence: Synthetic Linker
SSSSGSSSSG

SEQ ID NO: 319 - protein, 15 aa, Artificial Sequence
  Description of Artificial Sequence: Synthetic Linker
SSSSGSSSSGSSSSG

SEQ ID NO: 320 - protein, 20 aa, Artificial Sequence
  Description of Artificial Sequence: Synthetic Linker
SSSSGSSSSGSSSSGSSSSG

SEQ ID NO: 321 - protein, 25 aa, Artificial Sequence
  Description of Artificial Sequence: Synthetic Linker
SSSSGSSSSGSSSSGSSSSGSSSSG

SEQ ID NO: 322 - protein, 30 aa, Artificial Sequence
  Description of Artificial Sequence: Synthetic Linker
SSSSGSSSSGSSSSGSSSSGSSSSGSSSSG

SEQ ID NO: 323 - protein, 26 aa, Artificial Sequence
  Description of Artificial Sequence: Synthetic Linker
SGGGSGGGGSGGGGSGGGGSGGGSLQ

SEQ ID NO: 324 - DNA, 78 bp, Artificial Sequence
  Description of Artificial Sequence: Synthetic Linker
tcaggtggcggtagtggtgggggaggatctggaggcggaggaagcgggggtggaggttcaggaggagggagcttgcaa

SEQ ID NO: 325 - protein, 6 aa, Artificial Sequence
  Description of Artificial Sequence: Synthetic Linker
EFSTEF

SEQ ID NO: 326 - DNA, 18 bp, Artificial Sequence
  Description of Artificial Sequence: Synthetic Linker
gagttcagcaccgagttt

SEQ ID NO: 327 - DNA, 18 bp, Artificial Sequence
  Description of Artificial Sequence: Synthetic Linker
gagttctccaccgagttc

SEQ ID NO: 328 - protein, 12 aa, Artificial Sequence
  Description of Artificial Sequence: Synthetic Linker
GKSSGSGSESKS

SEQ ID NO: 329 - protein, 15 aa, Artificial Sequence
  Description of Artificial Sequence: Synthetic Linker
GGSTSGSGKSSEGKG

SEQ ID NO: 330 - protein, 19 aa, Artificial Sequence
  Description of Artificial Sequence: Synthetic Linker
GSTSGSGKSSSEGSGSTKG

SEQ ID NO: 331 - protein, 18 aa, Artificial Sequence
  Description of Artificial Sequence: Synthetic Linker
GSTSGSGKPGSGEGSTKG

SEQ ID NO: 332 - protein, 13 aa, Artificial Sequence
  Description of Artificial Sequence: Synthetic Linker
VDYPYDVPDYALD

SEQ ID NO: 333 - DNA, 39 bp, Artificial Sequence
  Description of Artificial Sequence: Synthetic Linker
gtcgactatccctacgatgttccggactacgcactggac

SEQ ID NO: 334 - protein, 14 aa, Artificial Sequence
  Description of Artificial Sequence: Synthetic Linker
EGKSSGSGSESKEF

SEQ ID NO: 335 - DNA, 603 bp, Artificial Sequence
  Description of Artificial Sequence: Synthetic Promoter sequence
aagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctactaga

SEQ ID NO: 336 - DNA, 1339 bp, Artificial Sequence
  Description of Artificial Sequence: Synthetic Promoter sequence
cgatagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgag

SEQ ID NO: 337 - DNA, 1335 bp, Artificial Sequence
  Description of Artificial Sequence: Synthetic Promoter sequence
gagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 338 - DNA, 399 bp, Artificial Sequence
  Description of Artificial Sequence: Synthetic Promoter sequence
ccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcagcc

SEQ ID NO: 339 - DNA, 978 bp, Homo sapiens
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 340 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKFQALAEQQ

SEQ ID NO: 341 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFADAICLQLYEALTHVSEDCFPLLDGCRKNRQKWQALAEQQ

SEQ ID NO: 342 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLAEALTHVSEDCFPLLDGCRKNRQKWQALAEQQ

SEQ ID NO: 343 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFADQGDRERKELNIEPTDLMNREKKNKIPSMQVGFIDAICLQLYEALTHVSEDCFPLLDGCRKNRQKWQALAEQQ

SEQ ID NO: 344 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 345 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLLHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 346 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALLIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 347 - protein, 327 aa, Artificial Sequence
  Description of Artificial Sequence: Synthetic Destabilizing Domain (DD)
MEETRELQSLAAAVVPSAQTLKITDFSFSDFELSDLETALCTIRMFTDLNLVQNFQMKHEVLCRWILSVKKNYRKNVAYHNWRHAFNTAQCIFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 348 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSADLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 349 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACALSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 350 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaattccaggcccttgcagaacagcag

SEQ ID NO: 351 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcgccgatgccatctgcttgcaactgtatgaggccctgacccacgtgtcagaggactgtttccctttgctagatggctgcagaaagaacaggcagaaatggcaggcccttgcagaacagcag

SEQ ID NO: 352 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactggccgaggccctgacccacgtgtcagaggactgtttccctttgctagatggctgcagaaagaacaggcagaaatggcaggcccttgcagaacagcag

SEQ ID NO: 353 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaatttgccgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 354 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgccgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 355 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 356 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttgctgcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 357 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgctgattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 358 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 359 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 360 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatctttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 361 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagcgccgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 362 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgccctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 363 - protein, 427 aa, Aequorea coerulescens
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 364 - protein, 550 aa, Photinus pyralis
MEDAKNIKKGPAPFYPLEDGTAGEQLHKAMKRYALVPGTIAFTDAHIEVNITYAEYFEMSVRLAEAMKRYGLNTNHRIVVCSENSLQFFMPVLGALFIGVAVAPANDIYNERELLNSMNISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKSKL

SEQ ID NO: 365 - protein, 239 aa, Aequorea coerulescens
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 366 - protein, 549 aa, Artificial Sequence
  Description of Artificial Sequence: Synthetic Payload sequence
EDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 367 - protein, 878 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 368 - protein, 878 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 369 - protein, 878 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 370 - protein, 567 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSADLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 371 - protein, 567 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACALSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 372 - DNA, 714 bp, Artificial Sequence
  Description of Artificial Sequence: Synthetic Payload sequence
gtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaag

SEQ ID NO: 373 - DNA, 717 bp, Artificial Sequence
  Description of Artificial Sequence: Synthetic Payload sequence
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaag

SEQ ID NO: 374 - DNA, 1647 bp, Artificial Sequence
  Description of Artificial Sequence: Synthetic Payload sequence
gaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtg

SEQ ID NO: 375 - DNA, 2637 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgtaa

SEQ ID NO: 376 - DNA, 2637 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgtaa

SEQ ID NO: 377 - DNA, 2637 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgtaa

SEQ ID NO: 378 - DNA, 1704 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagcgccgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 379 - DNA, 1704 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgccctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 380 - DNA, 2499 bp, Homo sapiens
atgttgccctttggagacaaaacaagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaac

SEQ ID NO: 381 - DNA, 2469 bp, Homo sapiens
atggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaac

SEQ ID NO: 382 - protein, 643 aa, Homo sapiens
MERAGPSFGQQRQQQQPQQQKQQQRDQDSVEAWLDDHWDFTFSYFVRKATREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQILTSVGID

SEQ ID NO: 383 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRGGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 384 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRAGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 385 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRVGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 386 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRIGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 387 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRPGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 388 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRFGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 389 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRWGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 390 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRYGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 391 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRHGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 392 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRSGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 393 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRTGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 394 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRDGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 395 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKREGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 396 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRQGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 397 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRNGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 398 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRMGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 399 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRCGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 400 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRKGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 401 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggggcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 402 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggggaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 403 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggcgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 404 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggcaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 405 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggttaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 406 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggtgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 407 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggtaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 408 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggattggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 409 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggccgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 410 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggccaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 411 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtttggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 412 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtggggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 413 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtatggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 414 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 415 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcatggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 416 - DNA, 978 bp, Artificial Sequence; identical to SEQ ID NO: 415
  Description of Artificial Sequence: Synthetic Destabilizing Domain (DD)

SEQ ID NO: 417 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggagcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 418 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtcaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 419 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 420 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggatggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 421 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 422 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggaaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 423 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 424 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 425 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcaaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 426 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 427 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggatgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 428 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtgcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 429 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaaaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 430 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRGGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 431 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRAGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 432 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRVGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 433 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRIGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 434 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRPGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 435 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRFGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 436 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRWGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 437 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRYGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 438 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRHGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 439 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRSGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 440 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRTGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 441 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRDGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 442 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKREGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 443 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRQGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 444 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRNGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 445 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRMGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 446 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRCGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 447 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRKGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 448 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRGGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 449 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRAGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 450 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 451 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRMGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 452 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRFGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 453 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRWGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 454 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRKGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 455 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRQGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 456 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKREGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 457 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRSGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 458 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRPGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 459 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRVGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 460 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRIGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 461 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRCGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 462 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRYGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 463 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRHGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 464 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRNGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 465 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRDGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 466 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRTGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 467 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggggcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 468 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggcgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 469 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggtgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 470 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggattggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 471 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggccgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 472 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtttggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 473 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtggggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 474 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtatggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 475 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcatggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 476 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggagcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 477 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 478 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggatggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 479 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggaaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 480 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 481 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 482 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggatgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 483 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtgcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 484 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaaaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 485 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggggaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 486 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggcaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 487 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggttaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 488 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggatgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 489 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtttggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 490 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtggggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 491 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaaaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 492 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcaaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 493 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 494 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtcaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 495 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggccaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 496 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggtaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 497 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggattggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 498 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtgcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 499 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 500 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 501 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 502 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 503 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 504 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFAELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 505 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 506 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAFHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 507 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAWHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 508 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAAHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 509 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSADLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 510 - protein, 326 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACALSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 511 - protein, 567 aa, Artificial Sequence
  Description of Artificial Sequence: Synthetic polypeptide
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 512 - protein, 567 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 513 - protein, 567 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKSGEETRELQSLAAAVVPSAQTLKITDFSFSDFELSDLETALCTIRMFTDLNLVQNFQMKHEVLCRWILSVKKNYRKNVAFHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 514 - protein, 567 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKSGEETRELQSLAAAVVPSAQTLKITDFSFSDFELSDLETALCTIRMFTDLNLVQNFQMKHEVLCRWILSVKKNYRKNVAWHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 515 - protein, 567 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKSGEETRELQSLAAAVVPSAQTLKITDFSFSDFELSDLETALCTIRMFTDLNLVQNFQMKHEVLCRWILSVKKNYRKNVAAHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 516 - protein, 567 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSADLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 517 - protein, 567 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACALSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 518 - protein, 569 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSR

SEQ ID NO: 519 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgctgaacttataagaaaaaatcaattcaatttggaagatcctcatcaaaaggagttgtttttggcaatgctgatgacagcttgtaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 520 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 521 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctttcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 522 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctggcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 523 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgccgctcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 524 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagcgccgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 525 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgccctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 526 - DNA, 1704 bp, Artificial Sequence
  Description of Artificial Sequence: Synthetic polynucleotide
atggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 527 - DNA, 1704 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 528 - DNA, 1704 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctttcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 529 - DNA, 1704 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctggcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 530 - DNA, 1704 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgccgctcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 531 - DNA, 1704 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagcgccgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 532 - DNA, 1704 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgccctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 533 - DNA, 1710 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtctagataa

SEQ ID NO: 534 - protein, 302 aa, Artificial Sequence
  Description of Artificial Sequence: Synthetic Destabilizing Domain (DD)
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 535 - protein, 294 aa, Artificial Sequence
  Description of Artificial Sequence: Synthetic Destabilizing Domain (DD)
SDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 536 - DNA, 978 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 537 - DNA, 906 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 538 - DNA, 882 bp, Artificial Sequence
  Description of Artificial Sequence: Synthetic Destabilizing Domain (DD)
agtgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 539 - protein, 121 aa, Artificial Sequence
  Description of Artificial Sequence: Synthetic heavy chain variable domain
EVQLVESGGGLVQPGGSLRLSCAASGFTFSSYWMSWVRQAPGKGLEWVSAISGSGGSTYYADSVKGRFTISRDNSKNTLYLQMNSLRAEDTAVYYCARDRYSNYVGWFDPWGQGTLVTVSS

SEQ ID NO: 540 - protein, 123 aa, Artificial Sequence
  Description of Artificial Sequence: Synthetic heavy chain variable domain
QVQLVQSGGGLVQPGGSLRLSCAASGFTFSSYEMNWVRQAPGKGLEWVSYISSSGSTIYYADSVKGRFTISRDNAKNSLYLQMNSLRAEDTAVYYCAREMQFGWELLGAFDIWGQGTMVTVSS

SEQ ID NO: 541 - protein, 139 aa, Artificial Sequence
  Description of Artificial Sequence: Synthetic heavy chain variable domain
MNFGLSLIFLVLILKGVQCEVMLVESGGGLVKPGGSLKLSCAASGFTFSSYTMSWVRQTPEKRLEWVASISSGGGNTYYADSVKGRFTMSRDNAKNNLYLQMSSLRSEDTALYYCARSYYYGISYDTYWGQGTLVTVSA

SEQ ID NO: 542 - protein, 136 aa, Artificial Sequence
  Description of Artificial Sequence: Synthetic heavy chain variable domain
MDWLWNLLFLMAAAQSIQAQIQLVQSGPELKKPGETVKISCKASGYTFTNYGMNWVKQAPGKGLKWMGWINTDTGKPTYTEEFKGRFAFSLATSASTAYLQINNLRNEDTATYFCGRVTADSMDYWGQGTSVTVSS

SEQ ID NO: 543 - protein, 119 aa, Artificial Sequence
  Description of Artificial Sequence: Synthetic heavy chain variable domain
QVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTV

SEQ ID NO: 544 - protein, 117 aa, Artificial Sequence
  Description of Artificial Sequence: Synthetic heavy chain variable domain
QVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTV

SEQ ID NO: 545 - protein, 119 aa, Artificial Sequence
  Description of Artificial Sequence: Synthetic heavy chain variable domain
QVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTV

SEQ ID NO: 546 - protein, 120 aa, Artificial Sequence
  Description of Artificial Sequence: Synthetic heavy chain variable domain
ALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSS

SEQ ID NO: 547 - protein, 119 aa, Artificial Sequence
  Description of Artificial Sequence: Synthetic heavy chain variable domain
QVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTV

SEQ ID NO: 548 - protein, 118 aa, Artificial Sequence
  Description of Artificial Sequence: Synthetic heavy chain variable domain
DVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITSS

SEQ ID NO: 549 - protein, 119 aa, Artificial Sequence; identical to SEQ ID NO: 543
  Description of Artificial Sequence: Synthetic heavy chain variable domain

SEQ ID NO: 550 - protein, 117 aa, Artificial Sequence; identical to SEQ ID NO: 544
  Description of Artificial Sequence: Synthetic heavy chain variable domain

SEQ ID NO: 551 - protein, 119 aa, Artificial Sequence; identical to SEQ ID NO: 545
  Description of Artificial Sequence: Synthetic heavy chain variable domain

SEQ ID NO: 552 - protein, 120 aa, Artificial Sequence
  Description of Artificial Sequence: Synthetic heavy chain variable domain
QVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSS

SEQ ID NO: 553 - protein, 118 aa, Artificial Sequence
  Description of Artificial Sequence: Synthetic heavy chain variable domain
DVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSS

SEQ ID NO: 554 - protein, 120 aa, Artificial Sequence; identical to SEQ ID NO: 546
  Description of Artificial Sequence: Synthetic heavy chain variable domain

SEQ ID NO: 555 - protein, 119 aa, Artificial Sequence; identical to SEQ ID NO: 547
  Description of Artificial Sequence: Synthetic heavy chain variable domain

SEQ ID NO: 556 - protein, 119 aa, Artificial Sequence
  Description of Artificial Sequence: Synthetic heavy chain variable domain
DVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSS

SEQ ID NO: 557 - protein, 120 aa, Artificial Sequence; identical to SEQ ID NO: 552
  Description of Artificial Sequence: Synthetic heavy chain variable domain

SEQ ID NO: 558 - protein, 118 aa, Artificial Sequence; identical to SEQ ID NO: 553
  Description of Artificial Sequence: Synthetic heavy chain variable domain

SEQ ID NO: 559 - protein, 121 aa, Artificial Sequence
  Description of Artificial Sequence: Synthetic heavy chain variable domain
EVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARYQDWWYLGQFDQWGQGTLVTVSS

SEQ ID NO: 560 - protein, 122 aa, Artificial Sequence
  Description of Artificial Sequence: Synthetic heavy chain variable domain
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGSYYSGRYDAWGQGTLVTVSS

SEQ ID NO: 561 - protein, 122 aa, Artificial Sequence
  Description of Artificial Sequence: Synthetic heavy chain variable domain
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCAREIRGYYYYYGMDVWGQGTTVTVSS

SEQ ID NO: 562 - protein, 124 aa, Artificial Sequence
  Description of Artificial Sequence: Synthetic heavy chain variable domain
EVQLVESGGGLVQPGRSLRLSCAASGFTFDDYAMHWVRQAPGKGLEWVSGISWNSGRIGYADSVKGRFTISRDNAKNSLYLQMNSLRAEDTAVYYCARADDYGAPYYYYGMDVWGQGTTVTVSS

SEQ ID NO: 563 - protein, 117 aa, Artificial Sequence
  Description of Artificial Sequence: Synthetic heavy chain variable domain
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCATGYGGYFDYWGQGTLVTVSS

SEQ ID NO: 564 - protein, 120 aa, Artificial Sequence
  Description of Artificial Sequence: Synthetic heavy chain variable domain
EVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDSYYYYYGMDVWGQGTTVTVSS

SEQ ID NO: 565 - protein, 117 aa, Artificial Sequence
  Description of Artificial Sequence: Synthetic heavy chain variable domain
EVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSS

SEQ ID NO: 566 - protein, 124 aa, Artificial Sequence
  Description of Artificial Sequence: Synthetic heavy chain variable domain
EVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSS

SEQ ID NO: 567 - protein, 126 aa, Artificial Sequence
  Description of Artificial Sequence: Synthetic heavy chain variable domain
QMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSS

SEQ ID NO: 568 - protein, 121 aa, Artificial Sequence
  Description of Artificial Sequence: Synthetic heavy chain variable domain
EVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARFQDWWYLGQFDQWGQGTLVTVSS

SEQ ID NO: 569 - protein, 128 aa, Artificial Sequence
  Description of Artificial Sequence: Synthetic heavy chain variable domain
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARSPNPYYYDSSGYYYPGAFDIWGQGTMVTVS

SEQ ID NO: 570 - protein, 129 aa, Artificial Sequence
  Description of Artificial Sequence: Synthetic heavy chain variable domain
QVQLVESGAEVKKPGASVKVSCKASGYTFTGYYMHWVRQAPGQGLEWMGWINPNSGGTNYAQKFQGRVTMTRDTSISTAYMELSRLRSDDTAVYYCARSPNPYYYDSSGYYYPGAFDIWGQGTMVTVSS

SEQ ID NO: 571 - protein, 118 aa, Artificial Sequence
  Description of Artificial Sequence: Synthetic heavy chain variable domain
QVQLQQSAAELARPGASVKMSCKASGYTFTSVTMHWVKQRPGQGLEWIGYINPYTGYSEYNLRFKDKTTLTADKSSSTAVMQLRSLTSEDSAAYYCARENYKDAMDYWGQGTSVTVSS

SEQ ID NO: 572 - protein, 117 aa, Artificial Sequence
  Description of Artificial Sequence: Synthetic heavy chain variable domain
DVQLVESGGGLVQPGGSRKLSCAASGFTFSRFGMHWVRQAPEKGLEWVAYISSGSSTIYVADTVKGRFTISRDNPKNTLFLQMTSLRSEDTAMYVCARKDSYAMDYWGQGTSVTVSS

SEQ ID NO: 573 - protein, 139 aa, Artificial Sequence
  Description of Artificial Sequence: Synthetic heavy chain variable domain
MAVVTGVNSEVQLQQSGAELVRPGALVKLSCKASGFNFKQYFMHWVRQRPEQGLEWIGRIDPENGNTLYDPKFQDKASITADTSSNTAYLQLSSLTSADTAVYYCARIYGDYGAMDYWGQGTSVTVSSAKTTPPSVYPR

SEQ ID NO: 574 - protein, 117 aa, Artificial Sequence
  Description of Artificial Sequence: Synthetic heavy chain variable domain
QVQLQQSGAELAKPGASVKMSCKASGVTHSYWMHWIKQRPGQGLEWIGYINPTIGLTDYNQKFTDKATLTADKSSSTAYMQLTSLTSEDSAVYYCAREGYKDALDYWGQGNSVTVSS

SEQ ID NO: 575 - protein, 117 aa, Artificial Sequence
  Description of Artificial Sequence: Synthetic heavy chain variable domain
EVQLQQSGPELVKPGASVKMSCKASGYTFISDVLHWVKQKPGQGLEWIGYINPYNDATEYDEKFKGKATLTSDRSSSTAYMELSSLTSEDSAVYYCARRGLIGADYWGQGTTLTVSS

SEQ ID NO: 576 - protein, 118 aa, Artificial Sequence
  Description of Artificial Sequence: Synthetic heavy chain variable domain
EVRLQESGPSLVKPSQTLSLTCSVTGDSITSDYWNWIRKFPGNKLEYMGYISYSGNTYYNPSLKSRISITRDTSKNQYYLHLNSVTTEDAATYYCARSYLYDGYLDYWGQGTSLTVSS

SEQ ID NO: 577 - protein, 96 aa, Artificial Sequence
  Description of Artificial Sequence: Synthetic heavy chain variable domain
TGYTFSSYWIEWVKQRPGHGLEWIGQILPGSGTTYYNEKFKGKATFTADTSSNTAYMQLSSITSEDSAVYYCTIYGNYFYYTMDYWGQGTSVTVSS

SEQ ID NO: 578 - protein, 116 aa, Artificial Sequence
  Description of Artificial Sequence: Synthetic heavy chain variable domain
QVQLQQSGAELARPGASVKLSCKASGSTFTSYWMQWVKQRPGQGLEWIGAIYPGQGDTRYAQEFKGKATLTADKSSSTAYMQLNTLASEQSAVYYCAEGPYFFDCWGQGTTLTVSS

SEQ ID NO: 579 - protein, 118 aa, Artificial Sequence
  Description of Artificial Sequence: Synthetic heavy chain variable domain
EVQLQQSGAELVKPGASVKLSCTASGFNIKDTYMQWVKQRPEQGLEWIGRIDPANGNTKYQPKFQGKATITTDTSSNTAYLQLSSLTSEDTAVYYCARPFGSFAMDYWGQGTSVTVSS

SEQ ID NO: 580 - protein, 111 aa, Artificial Sequence
  Description of Artificial Sequence: Synthetic heavy chain variable domain
GGGLVKPGGSLKLSCAASGFAFSNYAMSWVRQTPEKRLEWVATIFSGVIYTYYPDSVKGRFTISRDNAKNTLYLQMSSLRSEDTAMYYCARYDALYVFDYWGQGTTLTVSS

SEQ ID NO: 581 - protein, 116 aa, Artificial Sequence
  Description of Artificial Sequence: Synthetic heavy chain variable domain
DVQLVESGGGLVQPGGSRKLSCMSGFTFSRFGMHWVRQAPEKGLEWVAYITSGSSTIYYADTVKGRFTISRDNPKNTLFLQMTSLRSEQTAMYYCAKYGNYAMDYWGQGTSVTVSS

SEQ ID NO: 582 - protein, 119 aa, Artificial Sequence
  Description of Artificial Sequence: Synthetic heavy chain variable domain
EVQLVESGGGLVKPGGSLKLSCAASGFTFSDYYMYWVRQTPEKRLEWVATISDGGSYTYYPDSVKGRFTISRDNAKNNLVLQMSSLKSEDAAMYYCARGVGYYWYFDVWGAGITVTVSS

SEQ ID NO: 583 - protein, 121 aa, Artificial Sequence
  Description of Artificial Sequence: Synthetic heavy chain variable domain
DVKVVESGGGLVKPGGSLKLSCAASGFTFSSYTMSWVRQTPEKRLEWVATISSGGGYTYYPDSVKGRFTISRDNAKNTLYLQMSGLKSEDTAMYYCTRDRHDGPGTWFAYWGQGTLVTVSA

SEQ ID NO: 584 - protein, 121 aa, Artificial Sequence
  Description of Artificial Sequence: Synthetic heavy chain variable domain
QVQLVQSGAEVKKPGASVKVSCKASGYTFTSYVMHWVRQAPGQRLEWMGYINPYNDAPKYNEKFKGRVTITRDTSASTAYMELSSLRSEDTAVYYCARGLGYALYYAMDYWGQGTTVTVSS

SEQ ID NO: 585 - protein, 121 aa, Artificial Sequence
  Description of Artificial Sequence: Synthetic heavy chain variable domain
QVQLVQSGAEVKKPGASVKVSCKASGYTFTSYVMHWVRQAPGQGLEWMGYINPYNDAPKYNEKFKGRVTMTRDTSISTAYMELSRLRSDDTAVYYCARGLGYALYYAMDYWGQGTTVTVSS

SEQ ID NO: 586 - protein, 121 aa, Artificial Sequence
  Description of Artificial Sequence: Synthetic heavy chain variable domain
QVQLVQSGAEVKKPGASVKVSCKASGYTFTSYVMHWVRQAPGQGLEWMGYINPYNDAPKYNEKFKGRVTMTRDTSTSTVYMELSSLRSEDTAVYYCARGLGYALYYAMDYWGQGTMVTVSS

SEQ ID NO: 587 - protein, 121 aa, Artificial Sequence
  Description of Artificial Sequence: Synthetic heavy chain variable domain
QVQLVQSGAEVKKPGASVKVSCKASGYTFTSYVMHWVRQAPGQGLEWMGYINPYNDAPKYNEKFKGRVTMTRDTSASTAYMELSSLRSDDTAVYYCARGLGYALYYAMDYWGQGTTVTVSS

SEQ ID NO: 588 - protein, 121 aa, Artificial Sequence
  Description of Artificial Sequence: Synthetic heavy chain variable domain
EVQLQQSGPELVKPGASVKMSCKASGYTFTSYVMHWVKQKPGQGLEWIGYINPYNDAPKYNEKFKGKATVTSDKSSGTAYMELSSLTSEDSAVYYCARGLGYALYYAMDYWGQGTSVTVSS

SEQ ID NO: 589 - protein, 121 aa, Artificial Sequence
  Description of Artificial Sequence: Synthetic heavy chain variable domain
QVQLVQSGAEVKKPGASVKVSCKASGYTFTSYVMHWVRQAPGQGLEWMGYINPYNDAPKYNEKFKGRVTMTSDTSASTAYMELSSLRSDDTAVYYCARGLGYALYYAMDYWGQGTTVTVSS

SEQ ID NO: 590 - protein, 121 aa, Artificial Sequence
  Description of Artificial Sequence: Synthetic heavy chain variable domain
QVQLVQSGAEVKKPGASVKVSCKASGYTFTSYVMHWVRQAPGQGLEWMGYINPYNDAPKYNEKFKGRVTITSDTSASTAYMELSSLRSDDTAVYYCARGLGYALYYAMDYWGQGTTVTVSS

SEQ ID NO: 591 - protein, 121 aa, Artificial Sequence
  Description of Artificial Sequence: Synthetic heavy chain variable domain
QVQLVQSGAEVKKPGASVKVSCKASGYTFTSYVMHWVRQAPGQGLEWMGYINPYNDAPKYNEKFKGRVTMTSDKSASTAYMELSSLRSDDTAVYYCARGLGYALYYAMDYWGQGTTVTVSS

SEQ ID NO: 592 - protein, 121 aa, Artificial Sequence
  Description of Artificial Sequence: Synthetic heavy chain variable domain
EVQLVQSGAEVKKPGASVKVSCKASGYTFTSYVMHWVRQAPGQGLEWMGYINPYNDAPKYNEKFKGRVTMTSDTSASTAYMELSSLRSDDTAVYYCARGLGYALYYAMDYWGQGTTVTVSS

SEQ ID NO: 593 - protein, 121 aa, Artificial Sequence
  Description of Artificial Sequence: Synthetic heavy chain variable domain
QVQLVQSGAEVKKPGASVKVSCKASGYTFTSYVMHWVRQAPGQGLEWMGYINPYNDAPKYNEKFKGKATMTSDTSASTAYMELSSLRSDDTAVYYCARGLGYALYYAMDYWGQGTTVTVSS

SEQ ID NO: 594 - protein, 448 aa, Artificial Sequence
  Description of Artificial Sequence: Synthetic heavy chain variable domain
QVQLVQSGAEVKKPGASVKVSCKASGYTFTSYVMHWVRQAPGQRLEWMGYINPYNDAPKYNEKFKGRVTITRDTSASTAYMELSSLRSEDTAVYYCARGLGYALYYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 595 - protein, 448 aa, Artificial Sequence
  Description of Artificial Sequence: Synthetic heavy chain variable domain
QVQLVQSGAEVKKPGASVKVSCKASGYTFTSYVMHWVRQAPGQGLEWMGYINPYNDAPKYNEKFKGRVTMTRDTSISTAYMELSRLRSDDTAVYYCARGLGYALYYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 596 - protein, 448 aa, Artificial Sequence
  Description of Artificial Sequence: Synthetic heavy chain variable domain
QVQLVQSGAEVKKPGASVKVSCKASGYTFTSYVMHWVRQAPGQGLEWMGYINPYNDAPKYNEKFKGRVTMTRDTSTSTVYMELSSLRSEDTAVYYCARGLGYALYYAMDYWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 597 - protein, 448 aa, Artificial Sequence
  Description of Artificial Sequence: Synthetic heavy chain variable domain
QVQLVQSGAEVKKPGASVKVSCKASGYTFTSYVMHWVRQAPGQGLEWMGYINPYNDAPKYNEKFKGRVTMTRDTSASTAYMELSSLRSDDTAVYYCARGLGYALYYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 598 - protein, 448 aa, Artificial Sequence
  Description of Artificial Sequence: Synthetic heavy chain variable domain
QVQLVQSGAEVKKPGASVKVSCKASGYTFTSYVMHWVRQAPGQGLEWMGYINPYNDAPKYNEKFKGKATMTSDTSASTAYMELSSLRSDDTAVYYCARGLGYALYYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 599 - protein, 118 aa, Artificial Sequence
  Description of Artificial Sequence: Synthetic heavy chain variable domain
QVQLQQSGAELVRPGASVKLSCKASGYSFTDFYINWVRQRPGQGLEWIARIFPGGDNTYYNEKFKGKATLTAEESSSTAYIQLSSLTSEDSAVYFCARRGLYYAMDYWGQGISVTVSS

SEQ ID NO: 600 - protein, 117 aa, Artificial Sequence
  Description of Artificial Sequence: Synthetic heavy chain variable domain
QVQLQQPGPELVKPGASVKISCKTSDYNFTRYYIHWVKQRPGQGLEWIGWIYPGTGDSKYNEKFKGRATLTADTSSSTAYQLSSQTSEDSAVYFCARNGNYWYFDVWGAGTAVTVSS

SEQ ID NO: 601 - protein, 118 aa, Artificial Sequence; identical to SEQ ID NO: 599
  Description of Artificial Sequence: Synthetic heavy chain variable domain

SEQ ID NO: 602 - protein, 119 aa, Artificial Sequence
  Description of Artificial Sequence: Synthetic heavy chain variable domain
EVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSS

SEQ ID NO: 603 - protein, 120 aa, Artificial Sequence
  Description of Artificial Sequence: Synthetic heavy chain variable domain
EVQLVESGGGLVQPGGSLRLSCAASGFTFSSYWMSWVRQAPGKGLEWVANIKQDGGEQYYVDSVKGRFTISRDNAKNSLYLQMNSLRAEDTAVYYCARDWNYGYYDMDVWGQGTTVTVSS

SEQ ID NO: 604 - protein, 121 aa, Artificial Sequence
  Description of Artificial Sequence: Synthetic heavy chain variable domain
EVQLLESGGGLVQPGGSLRLSCAASGFTFSNYAMSWVRQAPGKGLEWVSAIRGSGGSTYYADSVKGRFTISRDNSKNTLYLQMNSLRAEDTAVYYCAKDLHYDSSGYLDYWGQGTLVTVSS

SEQ ID NO: 605 - protein, 119 aa, Artificial Sequence
  Description of Artificial Sequence: Synthetic heavy chain variable domain
EVQLVESGGGLVQPGGSLRLSCAASGFTFSSYWMSWVRQAPGKGLEWVANIKQDGGEKYYVDSVKGRFTISRDNAKNSLFLQMNSLRAEDTAVYYCARVQLYSDYFDYWGQGTLVTVSS

SEQ ID NO: 606 - protein, 121 aa, Artificial Sequence
  Description of Artificial Sequence: Synthetic heavy chain variable domain
EVQLLESGGDLVQPGGSLRLSCAASGFTFNSYAMSWVRQAPGKGLEWVSTISGSGGFTFSADSVKGRFTISRDNSKNTLFLQMNSLRVEDSAVYSCAKVLVGFNNGCWDYWGQGTLVTVSS

SEQ ID NO: 607 - protein, 121 aa, Artificial Sequence
  Description of Artificial Sequence: Synthetic heavy chain variable domain
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 608 - protein, 120 aa, Artificial Sequence
  Description of Artificial Sequence: Synthetic heavy chain variable domain
EVQLVESGGGLVKPGGSLRLSCAASGFTFSTYSMNWVRQAPGKGLEWVSSISSSGDYIYYADSVKGRFTISRDNAKNSLFLQMNSLKAEDTAVYYCARDLVTSMVAFDYWGQGTLVTVSS

SEQ ID NO: 609 - protein, 120 aa, Artificial Sequence
  Description of Artificial Sequence: Synthetic heavy chain variable domain
EVQLVESGGGLVKPGGSLRLSCAASGFTFSTYSMNWVRQAPGKGLEWVSSISSSGDYIYYADSVKGRFTISRDNAKNSLYLQMNSLRAEDTAVYYCARDLVTSMVAFDYWGQGTLVTVSS

SEQ ID NO: 610 - protein, 448 aa, Artificial Sequence
  Description of Artificial Sequence: Synthetic heavy chain variable domain
QVQLVQSGAEVKKPGASVKLSCKASGYTFTNYDINWVRQAPGQGLEWIGWIFPGDGSTQYNEKFKGKATLTTDTSTSTAYMELSSLRSEDTAVYFCARQTTATWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 611 - protein, 448 aa, Artificial Sequence
  Description of Artificial Sequence: Synthetic heavy chain variable domain
QVQLVQSGAEVVKPGASVKLSCKASGYTFTNYDINWVRQAPGQGLEWIGWIFPGDGSTQYNEKFKGKATLTTDTSTSTAYMELSRLTSEDTAVYFCARQTTATWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 612 - protein, 448 aa, Artificial Sequence
  Description of Artificial Sequence: Synthetic heavy chain variable domain
QVQLVQSGAEVVKPGASVKLSCKASGYTFTNYDINWVRQRPEQGLEWIGWIFPGDGSTQYNEKFKGKATLTTDTSTSTAYMELSSLRSEDTAVYFCARQTTATWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 613 - protein, 448 aa, Artificial Sequence
  Description of Artificial Sequence: Synthetic heavy chain variable domain
QVQLVQSGAEVVKPGASVKLSCKTSGYTFTNYDINWVRQRPGQGLEWIGWIFPGDDSTQYNEKFKGKATLTTDTSTSTAYMELSSLRSEDTAVYFCARQTTGTWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 614 - protein, 448 aa, Artificial Sequence
  Description of Artificial Sequence: Synthetic heavy chain variable domain
QVQLVQSGAEVVKPGASVKVSCKASGYTFTNYDINWVRQRPEQGLEWIGWIFPGDGSTQYNEKFKGRVTMTTDTSTSTVYMELSSLRSEDTAVYFCARQTTATWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 615 - protein, 448 aa, Artificial Sequence
  Description of Artificial Sequence: Synthetic heavy chain variable domain
QVQLVQSGAEVVKPGASVKVSCKTSGYTFTNYDINWVRQRPGQGLEWIGWIFPGDDSTQYNEKFKGRVTMTTDTSTSTVYMELSSLRSEDTAVYFCARQTTGTWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 616 - protein, 448 aa, Artificial Sequence
  Description of Artificial Sequence: Synthetic heavy chain variable domain
QVQLQQSGAELVKPGASVKLSCKTSGYTFTNYDINWVRQRPGQGLEWIGWIFPGDDSTQYNEKFKGKATLTTDTSSSTAYMQLSRLTSEDSAVYFCARQTTGTWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 617 - protein, 448 aa, Artificial Sequence
  Description of Artificial Sequence: Synthetic heavy chain variable domain
QVQLQQSGAELVKPGASVKLSCKASGYTFTNYDINWVRQRPEQGLEWIGWIFPGDGSTQYNEKFKGKATLTTDTSSSTAYMQLSRLTSEDSAVYFCARQTTATWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 618 - protein, 119 aa, Artificial Sequence
  Description of Artificial Sequence: Synthetic heavy chain variable domain
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGSYAFDIWGQGTMVTVSS

SEQ ID NO: 619 - protein, 119 aa, Artificial Sequence
  Description of Artificial Sequence: Synthetic heavy chain variable domain
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGSGSYHMDVWGKGTTVTVSS

SEQ ID NO: 620 - protein, 120 aa, Artificial Sequence
  Description of Artificial Sequence: Synthetic heavy chain variable domain
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGRRSGSYYMGYWGQGTLVTVSS

SEQ ID NO: 621 - protein, 121 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRVTLTADTSTSTAYLELSSLRSEDTAVYYCARLDGSSYRGAMDSWGQGTLVTVSS

SEQ ID NO: 622 - protein, 121 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRATLTADTSTSTAYLELSSLRSEDTAVYYCARLDGSSYRGAMDSWGQGTLVTVSS

SEQ ID NO: 623 - protein, 121 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRATLTADKSTSTAYLELSSLRSEDTAVYYCARLDGSSYRGAMDSWGQGTLVTVSS

SEQ ID NO: 624 - protein, 121 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRATLTADKSSSTAYLELSSLRSEDTAVYYCARLDGSSYRGAMDSWGQGTLVTVSS

SEQ ID NO: 625 - protein, 116 aa, Artificial Sequence
  Description of Artificial Sequence: Synthetic heavy chain variable domain
EVQLVQSGAEVKKPGASVKVSCKASGYTFTNFWIHWVRQAPGQGLEWIGEIDPSDSYTNYNQKFKGRATLTVDTSTSTAYLELSSLRSEDTAVYYCAREITTVDYWGQGTLVTVSS

SEQ ID NO: 626 - protein, 116 aa, Artificial Sequence
  Description of Artificial Sequence: Synthetic heavy chain variable domain
EVQLVQSGAEVKKPGASVKVSCKASGYTFTNFWIHWVRQAPGQGLEWIGEIDPSDSYTNYNQKFKGRATLTRDTSTSTAYLELSSLRSEDTAVYYCSREITTVDYWGQGTLVTVSS

SEQ ID NO: 627 - protein, 116 aa, Artificial Sequence
  Description of Artificial Sequence: Synthetic heavy chain variable domain
EVQLVQSGAEVKKPGASVKVSCKASGYTFTNFWIHWVRQAPGQGLEWIGEIDPSDSYTNYNQKFKGRATITVDTSTSTAYLELSSLRSEDTAVYYCSREITTVDYWGQGTLVTVSS

SEQ ID NO: 628 - protein, 116 aa, Artificial Sequence
  Description of Artificial Sequence: Synthetic heavy chain variable domain
EVQLVQSGAEVKKPGASVKVSCKASGYTFTNFWIHWVRQAPGQGLEWIGEIDPSDSYTNYNQKFKGRVTLTVDTSTSTAYLELSSLRSEDTAVYYCSREITTVDYWGQGTLVTVSS

SEQ ID NO: 629 - protein, 116 aa, Artificial Sequence
  Description of Artificial Sequence: Synthetic heavy chain variable domain
EVQLVQSGAEVKKPGASVKVSCKASGYTFTNFWIHWVRQAPGQGLEWIGEIDPSDSYTNYNQKFKGRATLTVDTSTSTAYLELSSLRSEDTAVYYCSREITTVDYWGQGTLVTVSS

SEQ ID NO: 630 - protein, 116 aa, Artificial Sequence
  Description of Artificial Sequence: Synthetic heavy chain variable domain
EVQLVQSGAEVKKPGASVKVSCKASGYTFTNFWIHWVRQAPGQGLEWIGEIDPSDSYTNYNQKFKGRATLTVDKSTSTAYLELSSLRSEDTAVYYCSREITTVDYWGQGTLVTVSS

SEQ ID NO: 631 - protein, 116 aa, Artificial Sequence
  Description of Artificial Sequence: Synthetic heavy chain variable domain
EVQLVQSGAEVKKPGASVKVSCKASGYTFTNFWIHWVRQAPGQGLEWIGEIDPSDSYTNYNQKFKGRATLTVDKSTNTAYLELSSLRSEDTAVYYCSREITTVDYWGQGTLVTVSS

SEQ ID NO: 632 - protein, 116 aa, Artificial Sequence
  Description of Artificial Sequence: Synthetic heavy chain variable domain
EVQLVQSGAEVKKPGASVKVSCKASGYTFTNFWIHWVRQAPGQGLEWIGEIDPSDSYTNYNQKFKGRATLTVDKSSNTAYLELSSLRSEDTAVYYCSREITTVDYWGQGTLVTVSS

SEQ ID NO: 633 - protein, 120 aa, Artificial Sequence
  Description of Artificial Sequence: Synthetic heavy chain variable domain
EVQLQQSGPDLVKPGASVKISCKASGYSFTGYYIHWMKQSHGKSLEWIGRVNPNNGDPIYNQKFRGKAILTVDQSSNTAYMELRSLTSEASAVYYCARVLFYYGSPFAYWGQGTLVTVSA

SEQ ID NO: 634 - protein, 121 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLAGSSYRGAMDSWGQGTLVTVSS

SEQ ID NO: 635 - protein, 103 aa, Artificial Sequence
  Description of Artificial Sequence: Synthetic heavy chain variable domain
EVQLEESGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLL

SEQ ID NO: 636 - protein, 451 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLAGSSYRGAMDSWGQGTLVTVSSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 637 - protein, 451 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 638 - protein, 451 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLAGSSYRGAMDSWGQGTLVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 639 - protein, 451 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 640 - protein, 446 aa, Artificial Sequence
  Description of Artificial Sequence: Synthetic heavy chain variable domain
EVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 641 - protein, 112 aa, Artificial Sequence
  Description of Artificial Sequence: Synthetic heavy chain variable domain
EVQLVQSGAEVKKPGASVKVSCKASGYTFTSYYIHWVRQAPGQGLEWIGWINPGSGNTNYAQKFQGRVTITRDTSTSTAYLELSSLRSEDTAVYYCARFDYWGQGTLVTVSS

SEQ ID NO: 642 - protein, 121 aa, Artificial Sequence
  Description of Artificial Sequence: Synthetic heavy chain variable domain
QVQLQQSGAELMKPGASVKMSCKATGYTFSSYWIEWVKQRPGHGLEWIGEILPGTSITTYNAKFKVKATFTADTSSNTAYMQLSSLTSEDSAVYFCARYYFGSSSFYFDYWGQGTSLTVSS

SEQ ID NO: 643 - protein, 116 aa, Artificial Sequence
  Description of Artificial Sequence: Synthetic heavy chain variable domain
QVQLQQPGAELVKPGTSVKLSCKASGYTFTNFWIHWVIQRPGQGLEWIGEIDPSDSYTNYNQKFKGKATLTVDKSSNTAYMQLSSLTSEDSAVYYCSREITTVDYWGQGTTLTVSS

SEQ ID NO: 644 - protein, 121 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRATLTRDTSTSTAYLELSSLRSEDTAVYYCARLDGSSYRGAMDSWGQGTLVTVSS

SEQ ID NO: 645 - protein, 121 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRATITRDTSTSTAYLELSSLRSEDTAVYYCARLDGSSYRGAMDSWGQGTLVTVSS

SEQ ID NO: 646 - protein, 121 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSS

SEQ ID NO: 647 - protein, 121 aa, Artificial Sequence
  Description of Artificial Sequence: Synthetic heavy chain variable domain
QVQLQQSGAELVRPGTSVKMSCKASGYTFTSYWIGWAKQRPGHGFEWIGDIYPGGGYTNYNEKFKGKATLTADKSSSTAYMQFSSLTSEDSAIYYCARLDGSSYRGAMDSWGQGTSITVSS

SEQ ID NO: 648 - protein, 116 aa, Artificial Sequence
  Description of Artificial Sequence: Synthetic heavy chain variable domain
EVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSS

SEQ ID NO: 649 - protein, 121 aa, Artificial Sequence
  Description of Artificial Sequence: Synthetic heavy chain variable domain
EVQLVQSGAEVKKPGASVKVSCKASGYTFTSYWIGWVRQAPGQGLEWIGDIYPGGGYTNYNEKFKGRATITADTSTSTAYLELSSLRSEDTAVYYCARLDGSSYRGAMDSWGQGTLVTVSS

SEQ ID NO: 650 - protein, 446 aa, Artificial Sequence
  Description of Artificial Sequence: Synthetic heavy chain variable domain
EVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 651 - protein, 120 aa, Artificial Sequence
  Description of Artificial Sequence: Synthetic heavy chain variable domain
DVQLVESGGGLVQPGGSRKLSCAASGFTFSSYGIHWVRQVPEKGLEWVAFISSSNSTIYYADTVKGRFTISRDNAENTLFLQMTSLRSEDTAMYYCARPLYYYGSVMDYWGQGTSVTVSS

SEQ ID NO: 652 - protein, 117 aa, Artificial Sequence
  Description of Artificial Sequence: Synthetic heavy chain variable domain
VQLQQSGPELVKPGASVKISCKASGYTFTDYYMNWMKQSHGKSLEWIGDINPNNGGTSYNQKFKGKATLTVDKSSSTAYMELRSLTSEDSAVYYCARPYYYGSSYDYWGQGTTLTVS

SEQ ID NO: 653 - protein, 117 aa, Artificial Sequence
  Description of Artificial Sequence: Synthetic heavy chain variable domain
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 654 - protein, 117 aa, Artificial Sequence
  Description of Artificial Sequence: Synthetic heavy chain variable domain
QVQLVQSGSELKKPGASVKISCKASGYTFSNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 655 - protein, 117 aa, Artificial Sequence
  Description of Artificial Sequence: Synthetic heavy chain variable domain
QVQLVQSGSELKKPGASVKISCKASGYTFTNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 656 - protein, 117 aa, Artificial Sequence
  Description of Artificial Sequence: Synthetic heavy chain variable domain
QIQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 657 - protein, 117 aa, Artificial Sequence
  Description of Artificial Sequence: Synthetic heavy chain variable domain
QIQLVQSGSELKKPGASVKISCKASGYTFTNYGMNWVRQAPGQGLQWMGWINTDSGESTYAEEFKGRFAFSLDTSVNTAYLQITSLTAEDTGMYFCVRVGYDALDYWGQGTLVTVSS

SEQ ID NO: 658 - protein, 224 aa, Artificial Sequence
  Description of Artificial Sequence: Synthetic heavy chain variable domain
EVQLVESGGGLVQPGGSLRLSCAASGFTFSNFDMAWVRQAPGKGLVWVSSITTGGGDTYYADSVKGRFTISRDNAKSTLYLQMDSLRSEDTAVYYCVRHGYYDGYHLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 659 - protein, 120 aa, Artificial Sequence
  Description of Artificial Sequence: Synthetic heavy chain variable domain
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 660 - protein, 115 aa, Artificial Sequence
  Description of Artificial Sequence: Synthetic heavy chain variable domain
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS

SEQ ID NO: 661 - protein, 115 aa, Artificial Sequence
  Description of Artificial Sequence: Synthetic heavy chain variable domain
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 662 - protein, 120 aa, Artificial Sequence
  Description of Artificial Sequence: Synthetic heavy chain variable domain
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS

SEQ ID NO: 663 - protein, 123 aa, Artificial Sequence
  Description of Artificial Sequence: Synthetic heavy chain variable domain
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSS

SEQ ID NO: 664 - protein, 118 aa, Artificial Sequence
  Description of Artificial Sequence: Synthetic heavy chain variable domain
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSS

SEQ ID NO: 665 - protein, 115 aa, Artificial Sequence
  Description of Artificial Sequence: Synthetic heavy chain variable domain
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 666 - protein, 115 aa, Artificial Sequence
  Description of Artificial Sequence: Synthetic heavy chain variable domain
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 667 - protein, 115 aa, Artificial Sequence
  Description of Artificial Sequence: Synthetic heavy chain variable domain
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 668 - protein, 117 aa, Artificial Sequence
  Description of Artificial Sequence: Synthetic heavy chain variable domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSS

SEQ ID NO: 669 - protein, 114 aa, Artificial Sequence
  Description of Artificial Sequence: Synthetic heavy chain variable domain
EVQLVESGGGLVQPGGSLRLSCAVSGFALSNHGMSWVRRAPGKGLEWVSGIVYSGSTYYAASVKRFTISRDNSRNTLYLQMNSLRPEDTAIYYCSAHGGESDVWGQGTTVTVSS

SEQ ID NO: 670 - protein, 117 aa, Artificial Sequence
  Description of Artificial Sequence: Synthetic heavy chain variable domain
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSS

SEQ ID NO: 671 - protein, 115 aa, Artificial Sequence
  Description of Artificial Sequence: Synthetic heavy chain variable domain
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 672 - protein, 115 aa, Artificial Sequence; identical to SEQ ID NO: 666
  Description of Artificial Sequence: Synthetic heavy chain variable domain

SEQ ID NO: 673 - protein, 115 aa, Artificial Sequence
  Description of Artificial Sequence: Synthetic heavy chain variable domain
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 674 - protein, 121 aa, Artificial Sequence
  Description of Artificial Sequence: Synthetic heavy chain variable domain
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSS

SEQ ID NO: 675 - protein, 123 aa, Artificial Sequence
  Description of Artificial Sequence: Synthetic heavy chain variable domain
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSS

SEQ ID NO: 676 - protein, 119 aa, Artificial Sequence
  Description of Artificial Sequence: Synthetic heavy chain variable domain
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSS

SEQ ID NO: 677 - protein, 117 aa, Artificial Sequence
  Description of Artificial Sequence: Synthetic heavy chain variable domain
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSS

SEQ ID NO: 678 - protein, 120 aa, Artificial Sequence
  Description of Artificial Sequence: Synthetic heavy chain variable domain
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSS

SEQ ID NO: 679 - protein, 123 aa, Artificial Sequence
  Description of Artificial Sequence: Synthetic heavy chain variable domain
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS

SEQ ID NO: 680 - protein, 129 aa, Artificial Sequence
  Description of Artificial Sequence: Synthetic heavy chain variable domain
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS

SEQ ID NO: 681 - protein, 125 aa, Artificial Sequence
  Description of Artificial Sequence: Synthetic heavy chain variable domain
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSS

SEQ ID NO: 682 - protein, 118 aa, Artificial Sequence
  Description of Artificial Sequence: Synthetic heavy chain variable domain
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSS

SEQ ID NO: 683 - protein, 118 aa, Artificial Sequence
  Description of Artificial Sequence: Synthetic heavy chain variable domain
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSS

SEQ ID NO: 684 - protein, 124 aa, Artificial Sequence
  Description of Artificial Sequence: Synthetic heavy chain variable domain
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSS

SEQ ID NO: 685 - protein, 124 aa, Artificial Sequence
  Description of Artificial Sequence: Synthetic heavy chain variable domain
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSS

SEQ ID NO: 686 - protein, 117 aa, Artificial Sequence
  Description of Artificial Sequence: Synthetic heavy chain variable domain
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSS

SEQ ID NO: 687 - protein, 122 aa, Artificial Sequence
  Description of Artificial Sequence: Synthetic heavy chain variable domain
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSS

SEQ ID NO: 688 - protein, 117 aa, Artificial Sequence
  Description of Artificial Sequence: Synthetic heavy chain variable domain
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSS

SEQ ID NO: 689 - protein, 118 aa, Artificial Sequence
  Description of Artificial Sequence: Synthetic heavy chain variable domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSS

SEQ ID NO: 690 - protein, 124 aa, Artificial Sequence
  Description of Artificial Sequence: Synthetic heavy chain variable domain
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSS

SEQ ID NO: 691 - protein, 120 aa, Artificial Sequence
  Description of Artificial Sequence: Synthetic heavy chain variable domain
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSS

SEQ ID NO: 692 - protein, 117 aa, Artificial Sequence
  Description of Artificial Sequence: Synthetic heavy chain variable domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSS

SEQ ID NO: 693 - protein, 126 aa, Artificial Sequence
  Description of Artificial Sequence: Synthetic heavy chain variable domain
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSS

SEQ ID NO: 694 - protein, 122 aa, Artificial Sequence
  Description of Artificial Sequence: Synthetic heavy chain variable domain
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSS

SEQ ID NO: 695 - protein, 117 aa, Artificial Sequence
  Description of Artificial Sequence: Synthetic heavy chain variable domain
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 696 - protein, 121 aa, Artificial Sequence; identical to SEQ ID NO: 674
  Description of Artificial Sequence: Synthetic heavy chain variable domain

SEQ ID NO: 697 - protein, 123 aa, Artificial Sequence; identical to SEQ ID NO: 675
  Description of Artificial Sequence: Synthetic heavy chain variable domain

SEQ ID NO: 698 - protein, 119 aa, Artificial Sequence; identical to SEQ ID NO: 676
  Description of Artificial Sequence: Synthetic heavy chain variable domain

SEQ ID NO: 699 - protein, 117 aa, Artificial Sequence; identical to SEQ ID NO: 677
  Description of Artificial Sequence: Synthetic heavy chain variable domain

SEQ ID NO: 700 - protein, 120 aa, Artificial Sequence; identical to SEQ ID NO: 678
  Description of Artificial Sequence: Synthetic heavy chain variable domain

SEQ ID NO: 701 - protein, 123 aa, Artificial Sequence; identical to SEQ ID NO: 679
  Description of Artificial Sequence: Synthetic heavy chain variable domain

SEQ ID NO: 702 - protein, 129 aa, Artificial Sequence; identical to SEQ ID NO: 680
  Description of Artificial Sequence: Synthetic heavy chain variable domain

SEQ ID NO: 703 - protein, 125 aa, Artificial Sequence; identical to SEQ ID NO: 681
  Description of Artificial Sequence: Synthetic heavy chain variable domain

SEQ ID NO: 704 - protein, 118 aa, Artificial Sequence; identical to SEQ ID NO: 682
  Description of Artificial Sequence: Synthetic heavy chain variable domain

SEQ ID NO: 705 - protein, 118 aa, Artificial Sequence; identical to SEQ ID NO: 683
  Description of Artificial Sequence: Synthetic heavy chain variable domain

SEQ ID NO: 706 - protein, 124 aa, Artificial Sequence; identical to SEQ ID NO: 684
  Description of Artificial Sequence: Synthetic heavy chain variable domain

SEQ ID NO: 707 - protein, 124 aa, Artificial Sequence; identical to SEQ ID NO: 685
  Description of Artificial Sequence: Synthetic heavy chain variable domain

SEQ ID NO: 708 - protein, 117 aa, Artificial Sequence; identical to SEQ ID NO: 686
  Description of Artificial Sequence: Synthetic heavy chain variable domain

SEQ ID NO: 709 - protein, 122 aa, Artificial Sequence; identical to SEQ ID NO: 687
  Description of Artificial Sequence: Synthetic heavy chain variable domain

SEQ ID NO: 710 - protein, 117 aa, Artificial Sequence; identical to SEQ ID NO: 688
  Description of Artificial Sequence: Synthetic heavy chain variable domain

SEQ ID NO: 711 - protein, 118 aa, Artificial Sequence; identical to SEQ ID NO: 689
  Description of Artificial Sequence: Synthetic heavy chain variable domain

SEQ ID NO: 712 - protein, 124 aa, Artificial Sequence; identical to SEQ ID NO: 690
  Description of Artificial Sequence: Synthetic heavy chain variable domain

SEQ ID NO: 713 - protein, 126 aa, Artificial Sequence; identical to SEQ ID NO: 693
  Description of Artificial Sequence: Synthetic heavy chain variable domain

SEQ ID NO: 714 - protein, 121 aa, Artificial Sequence
  Description of Artificial Sequence: Synthetic heavy chain variable domain
QIQLVQSGPDLKKPGETVKLSCKASGYTFTNFGMNWVKQAPGKGFKWMAWINTYTGESYFADDFKGRFAFSVETSATTAYLQINLKTEDTATYFCARGEIYYGYDGGFAYWGQGTLVTVSA

SEQ ID NO: 715 - protein, 117 aa, Artificial Sequence
  Description of Artificial Sequence: Synthetic heavy chain variable domain
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS

SEQ ID NO: 716 - protein, 115 aa, Artificial Sequence
  Description of Artificial Sequence: Synthetic heavy chain variable domain
QIQLVQSGPELKKPGETVKISCKASGYTTHYSMNWVKQAPGKGLKWMGRITETGEPLYADDFKGRFAFSLETSASTAYLVINNLKNEDTATFFCSNDYLYSCDYWGQGTTLTVSS

SEQ ID NO: 717 - protein, 120 aa, Artificial Sequence; identical to SEQ ID NO: 659
  Description of Artificial Sequence: Synthetic heavy chain variable domain

SEQ ID NO: 718 - protein, 115 aa, Artificial Sequence; identical to SEQ ID NO: 660
  Description of Artificial Sequence: Synthetic heavy chain variable domain

SEQ ID NO: 719 - protein, 115 aa, Artificial Sequence; identical to SEQ ID NO: 661
  Description of Artificial Sequence: Synthetic heavy chain variable domain

SEQ ID NO: 720 - protein, 120 aa, Artificial Sequence; identical to SEQ ID NO: 662
  Description of Artificial Sequence: Synthetic heavy chain variable domain

SEQ ID NO: 721 - protein, 123 aa, Artificial Sequence; identical to SEQ ID NO: 663
  Description of Artificial Sequence: Synthetic heavy chain variable domain

SEQ ID NO: 722 - protein, 118 aa, Artificial Sequence; identical to SEQ ID NO: 664
  Description of Artificial Sequence: Synthetic heavy chain variable domain

SEQ ID NO: 723 - protein, 115 aa, Artificial Sequence; identical to SEQ ID NO: 665
  Description of Artificial Sequence: Synthetic heavy chain variable domain

SEQ ID NO: 724 - protein, 115 aa, Artificial Sequence; identical to SEQ ID NO: 666
  Description of Artificial Sequence: Synthetic heavy chain variable domain

SEQ ID NO: 725 - protein, 115 aa, Artificial Sequence; identical to SEQ ID NO: 667
  Description of Artificial Sequence: Synthetic heavy chain variable domain

SEQ ID NO: 726 - protein, 117 aa, Artificial Sequence; identical to SEQ ID NO: 668
  Description of Artificial Sequence: Synthetic heavy chain variable domain

SEQ ID NO: 727 - protein, 115 aa, Artificial Sequence; identical to SEQ ID NO: 673
  Description of Artificial Sequence: Synthetic heavy chain variable domain

SEQ ID NO: 728 - protein, 117 aa, Artificial Sequence; identical to SEQ ID NO: 670
  Description of Artificial Sequence: Synthetic heavy chain variable domain

SEQ ID NO: 729 - protein, 115 aa, Artificial Sequence; identical to SEQ ID NO: 671
  Description of Artificial Sequence: Synthetic heavy chain variable domain

SEQ ID NO: 730 - protein, 450 aa, Artificial Sequence
  Description of Artificial Sequence: Synthetic heavy chain variable domain
EVQLVESGGGLVQPGGSLRLSCAASGFTFSNFDMAWVRQAPGKGLVWVSSITTGGGDTYYADSVKGRFTISRDNAKSTLYLQMDSLRSEDTAVYYCVRHGYYDGYHLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 731 - protein, 119 aa, Artificial Sequence
  Description of Artificial Sequence: Synthetic heavy chain variable domain
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSS

SEQ ID NO: 732 - protein, 123 aa, Artificial Sequence
  Description of Artificial Sequence: Synthetic heavy chain variable domain
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARQGYSYYGYSDVWGQGTLVTVSS

SEQ ID NO: 733 - protein, 117 aa, Artificial Sequence
  Description of Artificial Sequence: Synthetic heavy chain variable domain
QVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSS

SEQ ID NO: 734 - protein, 117 aa, Artificial Sequence
  Description of Artificial Sequence: Synthetic heavy chain variable domain
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGRGTTLTVSS

SEQ ID NO: 735 - protein, 119 aa, Artificial Sequence
  Description of Artificial Sequence: Synthetic heavy chain variable domain
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSS

SEQ ID NO: 736 - protein, 117 aa, Artificial Sequence
  Description of Artificial Sequence: Synthetic heavy chain variable domain
QVQLVQSGSELKKPGESVKVSCKASGYTFTDYSINWVRQAPGQGLEWMGWINTETREPAYAYDFRGRFVFSLDTSVSTAYLQISSLKAEDTAVYYCALDYSYAMDYWGQGTLVTVSS

SEQ ID NO: 737 - protein, 117 aa, Artificial Sequence
  Description of Artificial Sequence: Synthetic heavy chain variable domain
QVQLVQSGSELKKPGESVKISCKASGYTFTDYSINWVRQAPGQGLEWMGWINTETREPAYAYDFRGRFVFSLDTSASTAYLQISSLKAEDTAVYFCALDYSYAMDYWGQGTLVTVSS

SEQ ID NO: 738 - protein, 117 aa, Artificial Sequence
  Description of Artificial Sequence: Synthetic heavy chain variable domain
QVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSS

SEQ ID NO: 739 - protein, 118 aa, Artificial Sequence
  Description of Artificial Sequence: Synthetic heavy chain variable domain
EVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARSQWGGVLDYWGQGTLVTVSS

SEQ ID NO: 740 - protein, 117 aa, Artificial Sequence
  Description of Artificial Sequence: Synthetic heavy chain variable domain
QIQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSS

SEQ ID NO: 741 - protein, 117 aa, Artificial Sequence; identical to SEQ ID NO: 734
  Description of Artificial Sequence: Synthetic heavy chain variable domain

SEQ ID NO: 742 - protein, 123 aa, Artificial Sequence
  Description of Artificial Sequence: Synthetic heavy chain variable domain
QVQLVESGAEVKKPGSSVKVSCKASGGTFSSYAISWVRQAPGQGLEWMGRIIPILGIANYAQKFQGRVTITADESTSTAYMELSSLRSEDTAVYYCARTGYESWGSYEVIDRWGQGTLVTVSS

SEQ ID NO: 743 - protein, 113 aa, Artificial Sequence
  Description of Artificial Sequence: Synthetic heavy chain variable domain
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTV

SEQ ID NO: 744 - protein, 121 aa, Artificial Sequence
  Description of Artificial Sequence: Synthetic heavy chain variable domain
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSS

SEQ ID NO: 745 - protein, 125 aa, Artificial Sequence
  Description of Artificial Sequence: Synthetic heavy chain variable domain
QVQLQESGPGLVKPSGTLSLTCGVSGGSISNSNWWSWVRQPPGKGLEWIGEIYHSGSTKYNPSLRSRVTISVDKSKNQFSLKLSSVTAADTAVYYCARRDNWKTPTTKIDGFDIWGQGTMVTVSS

SEQ ID NO: 746 - protein, 118 aa, Artificial Sequence
  Description of Artificial Sequence: Synthetic heavy chain variable domain
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARSQWGSSWDYWGQGTLVTVSS

SEQ ID NO: 747 - protein, 119 aa, Artificial Sequence
  Description of Artificial Sequence: Synthetic heavy chain variable domain
EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCARSSYHLYGYDSWGQGTLVTVSS

SEQ ID NO: 748 - protein, 120 aa, Artificial Sequence
  Description of Artificial Sequence: Synthetic heavy chain variable domain
QVQLVQSGAEVKKPGSSVKVSCKASGGTFSSYAISWVRQAPGQGLEWMGGIIPIFSTANYAQKFQGRVTMTTDTSTSTAYMELRSLRSDDTAVYYCARQPWTWYSPYDQWGQGTLVTVSS

SEQ ID NO: 749 - protein, 117 aa, Artificial Sequence
  Description of Artificial Sequence: Synthetic heavy chain variable domain
EVQLVETGGGLVQPGGSLRLSCAASGFTFSTYAMTWVRQAPGKGLEWVSAITPGGDRTYYADSVKGRFTISRDNSRNTLYLQMNSLRAEDTAVYYCARYYGYMIDMWGQGTLVTVSS

SEQ ID NO: 750 - protein, 118 aa, Artificial Sequence
  Description of Artificial Sequence: Synthetic heavy chain variable domain
QMQLVQSGAEVKKPGASVKVSCKASGYTFTGYYVHWLRQAPGQGLEWMGWINPNSGGTNNAQEFQGRITMTRDTSINTAYMELSRLRSDDTAVYYCARSQWGGTYDYWGQGTLVTVSS

SEQ ID NO: 751 - protein, 117 aa, Artificial Sequence
  Description of Artificial Sequence: Synthetic heavy chain variable domain
EVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSS

SEQ ID NO: 752 - protein, 123 aa, Artificial Sequence
  Description of Artificial Sequence: Synthetic heavy chain variable domain
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARYGFSGSRFYDTWGQGTLVTVSS

SEQ ID NO: 753 - protein, 118 aa, Artificial Sequence
  Description of Artificial Sequence: Synthetic heavy chain variable domain
EVQLVQSGAEMKKPGASLKLSCKASGYTFIDYYVYWMRQAPGQGLESMGWINPNSGGTNYAQKFQGRVTMTRDTSISTAYMELSRLRSDDTAMYYCARSQRDGYMDYWGQGTLVTVSS

SEQ ID NO: 754 - protein, 118 aa, Artificial Sequence
  Description of Artificial Sequence: Synthetic heavy chain variable domain
QVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSS

SEQ ID NO: 755 - protein, 120 aa, Artificial Sequence
  Description of Artificial Sequence: Synthetic heavy chain variable domain
QVQLVQSGAEVKKPGSSVKVSCKASGGTFSSYAISWVRQAPGQGLEWMGRIIPILGTANYAQKFQGRVTITADESTSTAYMELSSLRSEDTAVYYCARSGYGSYRWEDSWGQGTLVTVSS

SEQ ID NO: 756 - protein, 116 aa, Artificial Sequence
  Description of Artificial Sequence: Synthetic heavy chain variable domain
EVQLVQSGAEVKKPGESLKISCKGSGYSFTSYWIGWVRQMPGKGLEWMGIIYPGDSDTRYSPSFQGHVTISADKSISTAYLQWSSLKASDTAMYYCARYSGSFDNWGQGTLVTVSS

SEQ ID NO: 757 - protein, 122 aa, Artificial Sequence
  Description of Artificial Sequence: Synthetic heavy chain variable domain
EVQLVQSGAEVKKPGSSVKVSCKASGGTFSSYAISWVRQAPGQGLEWMGRIIPILGIANYAQKFQGRVTMTEDTSTDTAYMELSSLRSEDTAVYYCARSGYSKSIVSYMDYWGQGTLVTVSS

SEQ ID NO: 758 - protein, 119 aa, Artificial Sequence; identical to SEQ ID NO: 735
  Description of Artificial Sequence: Synthetic heavy chain variable domain

SEQ ID NO: 759 - protein, 119 aa, Artificial Sequence; identical to SEQ ID NO: 731
  Description of Artificial Sequence: Synthetic heavy chain variable domain

SEQ ID NO: 760 - protein, 117 aa, Artificial Sequence; identical to SEQ ID NO: 695
  Description of Artificial Sequence: Synthetic heavy chain variable domain

SEQ ID NO: 761 - protein, 121 aa, Artificial Sequence
  Description of Artificial Sequence: Synthetic heavy chain variable domain
EVQLVESGGGLVQPGGSLRLSCAASGFTFSNFDMAWVRQAPGKGLVWVSSITTGGGDTYYADSVKGRFTISRDNAKSTLYLQMDSLRSEDTAVYYCVRHGYYDGYHLFDYWGQGTLVTVSS

SEQ ID NO: 762 - protein, 138 aa, Artificial Sequence
  Description of Artificial Sequence: Synthetic heavy chain variable domain
MEWSWIFLFLLSGTAGVLSEVQLQQSGPELVKPGTSVKISCKASGYSFTGYYMHWVKQSQVKSLEWIGRINPDNGGRTYNQIFKDKASLTVHKSSSTAYMELHSLTSDDSAVYYCTRERGQYGNYGGFSDWGQGTLVT

SEQ ID NO: 763 - protein, 222 aa, Artificial Sequence
  Description of Artificial Sequence: Synthetic heavy chain variable domain
EVQLVESGGGLVQPGGSLRLSCAASGFTFEAYAMHWVRQSPGKGLEWVASINWNSGRIAYADSVKGRFTISADTSKNTAYLQMNSLRAEDTAIYYCSRDIRRFSTGAEFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 764 - protein, 219 aa, Artificial Sequence
  Description of Artificial Sequence: Synthetic heavy chain variable domain
QVQLQESGGGLVRPSQTLSLTCTVSGFTFTDFYMNWVRQSPGRGLEWIGFIRDKAKGYTTEYNPSVKGRVTMLVDTSKNQFSLRLSSVTAADTAWYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVE

SEQ ID NO: 765 - protein, 118 aa, Artificial Sequence
  Description of Artificial Sequence: Synthetic heavy chain variable domain
EVQLVESGGGLVKPGGSLRLSCAASGFTFSDAWMDWVRQAPGKGLEWVAEIRSKASNHATYYAESVKGRFTISRDDSKNTLYLQMNSLKTEDTAVYYCTRWRRFFDSWGQGTLVTVSS

SEQ ID NO: 766 - protein, 118 aa, Artificial Sequence
  Description of Artificial Sequence: Synthetic heavy chain variable domain
EVQLVESGGGLVKPGGSLRLSCAASGFTFSDAWMDWVRQAPGKGLEWVGEIRSQASNHATYYAESVKGRFTISRDDSKNTLYLQMNSLKTEDTAVYYCTRWRRFFDSWGQGTLVTVSS

SEQ ID NO: 767 - protein, 118 aa, Artificial Sequence
  Description of Artificial Sequence: Synthetic heavy chain variable domain
EVQLVESGGGLVKPGGSLRLSCAASGFTFSDAWMDWVRQAPGKGLEWVSEIRSKASNHATYYAESVKGRFTISRDDSKNTLYLQMNSLKTEDTAVYYCTRWRRFFDSWGQGTLVTVSS

SEQ ID NO: 768 - protein, 141 aa, Artificial Sequence
  Description of Artificial Sequence: Synthetic heavy chain variable domain
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAAS

SEQ ID NO: 769 - protein, 141 aa, Artificial Sequence; identical to SEQ ID NO: 768
  Description of Artificial Sequence: Synthetic heavy chain variable domain

SEQ ID NO: 770 - protein, 140 aa, Artificial Sequence
  Description of Artificial Sequence: Synthetic heavy chain variable domain
WTWRFLFVVAAATGVQSQVQLLQSGAEVKKPGSSVKVSCKASGGTFSTYAISWVRQAPGQGLEWMGGIIPIFGIVNYAQKFQGRVTITADESTSTAYMELSSLRSEDTAVYYCARGGGSGPDVLDIWGQGTMVTVSSAST

SEQ ID NO: 771 - protein, 127 aa, Artificial Sequence
  Description of Artificial Sequence: Synthetic heavy chain variable domain
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSS

SEQ ID NO: 772 - protein, 140 aa, Artificial Sequence; identical to SEQ ID NO: 770
  Description of Artificial Sequence: Synthetic heavy chain variable domain

SEQ ID NO: 773 - protein, 132 aa, Artificial Sequence
  Description of Artificial Sequence: Synthetic heavy chain variable domain
MDMRVPAQLLGLLLLWLPGARCVIWMTQSPSLLSASTGDRVTISCRMSQGIRSYLAWYQQKPGKAPELLIYAASTLQSGVPSRFSGSGSGTDFTLTISSLQSEDFATYYCQQYYSFPYTFGQGTKLEIKRTV

SEQ ID NO: 774 - protein, 119 aa, Artificial Sequence
  Description of Artificial Sequence: Synthetic heavy chain variable domain
VQLQESGPGLVKPSQSLSLTCSVTDYSITSGYYWNWIRQFPGNKLEWMGYISYDGSNNYNPSLKNRISITRDTSKNQFFLKLSSVTTEDTATYYCSRGEGFYFDSWGQGTTLTVSSARS

SEQ ID NO: 775 - protein, 127 aa, Artificial Sequence
  Description of Artificial Sequence: Synthetic heavy chain variable domain
EVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSS

SEQ ID NO: 776 - protein, 127 aa, Artificial Sequence
  Description of Artificial Sequence: Synthetic heavy chain variable domain
EVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSS

SEQ ID NO: 777 - protein, 127 aa, Artificial Sequence
  Description of Artificial Sequence: Synthetic heavy chain variable domain
EVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSS

SEQ ID NO: 778 - protein, 127 aa, Artificial Sequence
  Description of Artificial Sequence: Synthetic heavy chain variable domain
EVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSS

SEQ ID NO: 779 - protein, 127 aa, Artificial Sequence
  Description of Artificial Sequence: Synthetic heavy chain variable domain
EVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSS

SEQ ID NO: 780 - protein, 127 aa, Artificial Sequence
  Description of Artificial Sequence: Synthetic heavy chain variable domain
EVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSS

SEQ ID NO: 781 - protein, 127 aa, Artificial Sequence
  Description of Artificial Sequence: Synthetic heavy chain variable domain
EVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSS

SEQ ID NO: 782 - protein, 115 aa, Artificial Sequence
  Description of Artificial Sequence: Synthetic heavy chain variable domain
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSS

SEQ ID NO: 783 - protein, 118 aa, Artificial Sequence
  Description of Artificial Sequence: Synthetic heavy chain variable domain
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSS

SEQ ID NO: 784 - protein, 119 aa, Artificial Sequence; identical to SEQ ID NO: 774
  Description of Artificial Sequence: Synthetic heavy chain variable domain

SEQ ID NO: 785 - protein, 121 aa, Artificial Sequence
  Description of Artificial Sequence: Synthetic heavy chain variable domain
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSS

SEQ ID NO: 786 - protein, 121 aa, Artificial Sequence
  Description of Artificial Sequence: Synthetic heavy chain variable domain
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSS

SEQ ID NO: 787 - protein, 121 aa, Artificial Sequence
  Description of Artificial Sequence: Synthetic heavy chain variable domain
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSS

SEQ ID NO: 788 - protein, 121 aa, Artificial Sequence
  Description of Artificial Sequence: Synthetic heavy chain variable domain
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSS

SEQ ID NO: 789 - protein, 115 aa, Artificial Sequence
  Description of Artificial Sequence: Synthetic heavy chain variable domain
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 790 - protein, 126 aa, Artificial Sequence
  Description of Artificial Sequence: Synthetic heavy chain variable domain
EVKLVESGGGLVQPGRSLRLSCTASGFTFTDYYMSWVRQAPGKGLEWVGLIRSKADGYTTEYSASVKGRFTISRDDSQSIAYLQMNSLKTEDTAVYYCARDAAYYSYYSPEGAMDYGQGTLVTVSS

SEQ ID NO: 791 - protein, 125 aa, Artificial Sequence
  Description of Artificial Sequence: Synthetic heavy chain variable domain
EVQLVESGGGLVQPGRSLRLSCTASGFTFTDYYMSVRQAPGKGLEWVGLIRSKADGYTTEYSASVKGRFTISRDDSQSIAYLQMNSLKTEDTAVYYCARDAAYYSYYSPEGAMDYGQGTLVTVSS

SEQ ID NO: 792 - protein, 126 aa, Artificial Sequence
  Description of Artificial Sequence: Synthetic heavy chain variable domain
EVQLVESGGGLVQPGRSLRLSCTASGFTFTDYYMSWVRQAPGKGLEWVGLIRSKADGYTTEYAASVKGRFTISRDDSQSIAYLQMNSLKTEDTAVYYCARDAAYYSYYSPEGAMDYGQGTLVTVSS

SEQ ID NO: 793 - protein, 126 aa, Artificial Sequence
  Description of Artificial Sequence: Synthetic heavy chain variable domain
EVQLVESGGGLVQPGRSLRLSCTASGFTFTDYYMSVRQPPGKGLEWVGLIRSKADGYTTEYSASVKGRFTISRDDSQSIAYLQMNSLKTEDTAVYYCARDAAYYSYYSPEGAMDYWGQGTLVTVSS

SEQ ID NO: 794 - protein, 118 aa, Artificial Sequence
  Description of Artificial Sequence: Synthetic heavy chain variable domain
GVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARRVISGAFDIWGQGTMVTVSS

SEQ ID NO: 795 - protein, 123 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSDGSTRYVEKFQGRVTMTRDTSTSTVYMELSSLRSEDTAVYFCARGMGPGPHYHFYMDVWGKGTMVTVSS

SEQ ID NO: 796 - protein, 125 aa, Artificial Sequence
  Description of Artificial Sequence: Synthetic heavy chain variable domain
QVQLVQSGAEVKKPGASVKVSCKASGYTFTGQYIHWVRQAPGQGLEWMGWISAYNGYTDYAQKVQGRVTMTTDTSTSTAYMELRSLRSDDTAVYYCAREVWPVAAADTFSVFDIWGRGTLVTVSS

SEQ ID NO: 797 - protein, 120 aa, Artificial Sequence
  Description of Artificial Sequence: Synthetic heavy chain variable domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARGRTEVATPGAYWGQGTMVTVSS

SEQ ID NO: 798 - protein, 118 aa, Artificial Sequence
  Description of Artificial Sequence: Synthetic heavy chain variable domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDGTTGLHDSWGQGTMVTVSS

SEQ ID NO: 799 - protein, 112 aa, Artificial Sequence
  Description of Artificial Sequence: Synthetic heavy chain variable domain
EVQLVQSGAEVKKPGESLKISCKGYGYDFSRDWIAWVRQMPGKGLEWMGIIYPGDSDTRYSPSFEGQVTISADKSISTAYLQWRSLKASDTAMYYCARQRRLGWFDPWGQGT

SEQ ID NO: 800 - protein, 123 aa, Artificial Sequence
  Description of Artificial Sequence: Synthetic heavy chain variable domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARHLPSGSSSSWAFDSWGRGTTVTVSS

SEQ ID NO: 801 - protein, 122 aa, Artificial Sequence
  Description of Artificial Sequence: Synthetic heavy chain variable domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARYRDYGGNSHLFDYWGQGTTVTVSS

SEQ ID NO: 802 - protein, 118 aa, Artificial Sequence
  Description of Artificial Sequence: Synthetic heavy chain variable domain
QVTLKESGPGILQPSQTLSLTCSFSGFSLRTSGMGVGWIRQPSGKGLEWLAHIWWDDDKRYNPALKSRLTISKDTSSNQVFLKIASVDTADTATYYCAQINPAWFAYWGQGTLVTVSS

SEQ ID NO: 803 - protein, 449 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 804 - protein, 223 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 805 - protein, 234 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSNYHLENEVARLKKLSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 806 - protein, 460 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSNYHLENEVARLKKLSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 807 - protein, 241 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSNYHLENEVARLKKL

SEQ ID NO: 808 - protein, 471 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSNYHLENEVARLKKLGGSDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 809 - protein, 120 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 810 - protein, 111 aa, Artificial Sequence
  Description of Artificial Sequence: Synthetic heavy chain variable domain
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 811 - protein, 464 aa, Artificial Sequence
  Description of Artificial Sequence: Synthetic heavy chain variable domain
MEWSWIFLFLLSGTAGVHSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 812 - protein, 137 aa, Artificial Sequence
  Description of Artificial Sequence: Synthetic heavy chain variable domain
DIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDPLINKERGGGGSGGGGSGGGGS

SEQ ID NO: 813 - protein, 124 aa, Artificial Sequence
  Description of Artificial Sequence: Synthetic heavy chain variable domain
QVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSS

SEQ ID NO: 814 - protein, 130 aa, Artificial Sequence
  Description of Artificial Sequence: Synthetic heavy chain variable domain
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHIDYGSGSYSPRTSYYYYMSVWGKGTTVTVSS

SEQ ID NO: 815 - protein, 125 aa, Artificial Sequence
  Description of Artificial Sequence: Synthetic heavy chain variable domain
QVQLVQSGGGVVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSS

SEQ ID NO: 816 - protein, 125 aa, Artificial Sequence
  Description of Artificial Sequence: Synthetic heavy chain variable domain
EVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSS

SEQ ID NO: 817 - protein, 228 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 818 - protein, 98 aa, Artificial Sequence
  Description of Artificial Sequence: Synthetic heavy chain variable domain
  MOD_RES (64)..(65): Any amino acid
  MOD_RES (68)..(69): Any amino acid
  MOD_RES (93)..(93): Any amino acid
  MOD_RES (98)..(98): Any amino acid
QVQLVESGGGLVQPGRSLRLSCAASGFTFDDYAMHWVRQAPGKGLEWVSGISWNSGRIGYADSXXGRXXISRDNAKNSLFLQMNSLRAEDTAXYYCAX

SEQ ID NO: 819 - protein, 125 aa, Artificial Sequence
  Description of Artificial Sequence: Synthetic heavy chain variable domain
  MOD_RES (76)..(76): Any amino acid
QVQLVESGGGLVQPGRSLRLSCAASGFTFDDYAMHWVRQAPGKGLEWVSGISWNSGRIGYADSVKGRFTISRDNAXNSLFLQMNSLRAEDTAVYYCARDQGYHYYDSAEHAFDIWGQGTVVTVSS

SEQ ID NO: 820 - protein, 125 aa, Artificial Sequence
  Description of Artificial Sequence: Synthetic heavy chain variable domain
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSS

SEQ ID NO: 821 - protein, 125 aa, Artificial Sequence
  Description of Artificial Sequence: Synthetic heavy chain variable domain
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSS

SEQ ID NO: 822 - protein, 125 aa, Artificial Sequence
  Description of Artificial Sequence: Synthetic heavy chain variable domain
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSS

SEQ ID NO: 823 - protein, 125 aa, Artificial Sequence
  Description of Artificial Sequence: Synthetic heavy chain variable domain
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSS

SEQ ID NO: 824 - protein, 125 aa, Artificial Sequence
  Description of Artificial Sequence: Synthetic heavy chain variable domain
EVQLVESGGGLVQPGRSLRLSCAASGFTFDDYAMHWVRLAPGKGLEWVSGISWNSGRIGYADSVKGRFTISRDNAKNSLFLQMNSLRAKDTAVYYCARDQGYHYYDSAEHAFDIWGQGTMVTVSS

SEQ ID NO: 825 - protein, 125 aa, Artificial Sequence
  Description of Artificial Sequence: Synthetic heavy chain variable domain
QMQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSS

SEQ ID NO: 826 - protein, 464 aa, Artificial Sequence; identical to SEQ ID NO: 811
  Description of Artificial Sequence: Synthetic heavy chain variable domain

SEQ ID NO: 827 - protein, 120 aa, Artificial Sequence; identical to SEQ ID NO: 809
  Description of Artificial Sequence: Synthetic heavy chain variable domain

SEQ ID NO: 828 - protein, 218 aa, Artificial Sequence
  Description of Artificial Sequence: Synthetic heavy chain variable domain
EVQLVESGGGLVQPGGSLRLSCAASGVSLPDYGVSWVRQSPGKGLEWVAVIWGSETTYYADSVKGRFTISADTSKNTYLQMNSLRAEDTAWYCSRHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 829 - protein, 219 aa, Artificial Sequence
  Description of Artificial Sequence: Synthetic heavy chain variable domain
EVQLVESGGGLVQPGGSLRLSCAASGVSLPDYGVSWVRQSPGKGLEWVAVIWGSETTYYADSVKGRFTISADTSKNTYLQMNSLRAEDTAIYYCSRHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 830 - protein, 460 aa, Artificial Sequence; identical to SEQ ID NO: 806
  Description of Artificial Sequence: Synthetic heavy chain variable domain

SEQ ID NO: 831 - protein, 242 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSNYHLENEVARLKKL

SEQ ID NO: 832 - protein, 471 aa, Artificial Sequence; identical to SEQ ID NO: 808
  Description of Artificial Sequence: Synthetic heavy chain variable domain

SEQ ID NO: 833 - protein, 118 aa, Artificial Sequence
  Description of Artificial Sequence: Synthetic heavy chain variable domain
EVQLQQSGPELQRPGASVKLSCKASGYIFTEYYMYWVKQRPKQGLELVGRIDPEDGSIDYVEKFKKKATLTADTSSNTAYMQLSSLTSEDTATYFCARGKFNYRFAYWGQGTLVTVSS

SEQ ID NO: 834 - protein, 118 aa, Artificial Sequence
  Description of Artificial Sequence: Synthetic heavy chain variable domain
QVTLKESGPGILQPSQTLSLTCSFSGFSLRTSGMGVGWIRQPSGKGLEWLAHIWWDDDKRYNPALKSRLTISKDTSSNQVFLKIASVDTADTATYYCAQINPAWFAYWGQGTLVTVSA

SEQ ID NO: 835 - protein, 117 aa, Artificial Sequence
  Description of Artificial Sequence: Synthetic heavy chain variable domain
QVQLQQSGAELVRPGTSVKISCKASGYTFTNYWLGWVKQRPGHGLEWIGDIYPGGGYTNYNEKFKGKATVTADTSSRTAYVQVRSLTSEDSAVYFCARSASWYFDVWGARTTVTVSS

SEQ ID NO: 836 - protein, 122 aa, Artificial Sequence
  Description of Artificial Sequence: Synthetic heavy chain variable domain
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 837 - protein, 112 aa, Artificial Sequence
  Description of Artificial Sequence: Synthetic heavy chain variable domain
GPELVKPGASVKISCKASGYAFSYSWMNWVKLRPGQGLEWIGRIFPGDGDTDYNGKFKGKATLTADKSSNTAYMQLTSLTSVDSAVYLCARNVFDGYWLVYWGQGTLVTVSA

SEQ ID NO: 838 - protein, 119 aa, Artificial Sequence
  Description of Artificial Sequence: Synthetic heavy chain variable domain
QVQLVQSGAEVKKPGSSVKVSCKASGYTFSYSWMSWVRQAPGQGLEWMGRIFPGDGDTDYAQKFQGRVTITADKSTSTAYMELSSLRSEDTAVYYCARNVFDGYWLVYWGQGTLVTVSS

SEQ ID NO: 839 - protein, 119 aa, Artificial Sequence
  Description of Artificial Sequence: Synthetic heavy chain variable domain
QVQLVQSGAEVKKPGSSVKVSCKASGYAFSYSWMNWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 840 - protein, 119 aa, Artificial Sequence
  Description of Artificial Sequence: Synthetic heavy chain variable domain
QVQLVQSGAEVKKPGSSVKVSCKASGYAFSYSWMNWVRQAPGQGLEWMGRIFPGDGDTDYNGKFKGRVTITADKSTSTAYMELSSLRSEDTAVYLCARNVFDGYWLVYWGQGTLVTVSS

SEQ ID NO: 841 - protein, 119 aa, Artificial Sequence
  Description of Artificial Sequence: Synthetic heavy chain variable domain
QVQLVQSGAEVKKPGASVKVSCKVSGYAFSYSWMNWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 842 - protein, 119 aa, Artificial Sequence
  Description of Artificial Sequence: Synthetic heavy chain variable domain
QVQLVQSGAEVKKPGSSVKVSCKASGYAFSYSWMSWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 843 - protein, 119 aa, Artificial Sequence
  Description of Artificial Sequence: Synthetic heavy chain variable domain
QVQLVQSGAEVKKPGSSVKVSCKASGYAFSYSWISWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 844 - protein, 119 aa, Artificial Sequence
  Description of Artificial Sequence: Synthetic heavy chain variable domain
QVQLVQSGAEVKKPGASVKVSCKASGYTFTYSWMNWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 845 - protein, 119 aa, Artificial Sequence
  Description of Artificial Sequence: Synthetic heavy chain variable domain
QVQLVQSGAEVKKPGASVKVSCKASGYTFSYSWMNWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 846 - protein, 119 aa, Artificial Sequence
  Description of Artificial Sequence: Synthetic heavy chain variable domain
QVQLVQSGAEVKKPGASVKVSCKASGYTFTYSWMHWVRQAPGQGLEWMGRIFPGDGDTDYAQKFQGRVTMTRDTSTSTVYMELSSLRSEDTAVYYCARNVFDGYWLVYWGQGTLVTVSS

SEQ ID NO: 847 - protein, 119 aa, Artificial Sequence
  Description of Artificial Sequence: Synthetic heavy chain variable domain
EVQLVQSGAEVKKPGATVKISCKVSGYTFTYSWMHWVQQAPGKGLEWMGRIFPGDGDTDYAEKFQGRVTITADTSTDTAYMELSSLRSEDTAVYYCATNVFDGYWLVYWGQGTLVTVSS

SEQ ID NO: 848 - protein, 119 aa, Artificial Sequence
  Description of Artificial Sequence: Synthetic heavy chain variable domain
EVQLVQSGAEVKKPGATVKISCKVSGYTFTYSWMNWVQQAPGKGLEWMGRIFPGDGDTDYNGKFKGRVTITADTSTDTAYMELSSLRSEDTAVYYCATNVFDGYWLVYWGQGTLVTVSS

SEQ ID NO: 849 - protein, 119 aa, Artificial Sequence
  Description of Artificial Sequence: Synthetic heavy chain variable domain
QMQLVQSGAEVKKTGSSVKVSCKASGYTFTYSWMSWVRQAPGQGLEWMGRIFPGDGDTDYAQKFQGRVTITADKSTSTAYMELSSLRSEDTAVYYCARNVFDGYWLVYWGQGTLVTVSS

SEQ ID NO: 850 - protein, 119 aa, Artificial Sequence
  Description of Artificial Sequence: Synthetic heavy chain variable domain
EVQLVESGGGLVKPGGSLRLSCAASGFTFSYSWMNWVRQAPGKGLEWVGRIFPGDGDTDYNGKFKGRVTITADKSTSTAYMELSSLRSEDTAVYYCARNVFDGYWLVYWGQGTLVTVSS

SEQ ID NO: 851 - protein, 119 aa, Artificial Sequence
  Description of Artificial Sequence: Synthetic heavy chain variable domain
EVQLVESGGGLVKPGGSLRLSCAASGFAFSYSWMNWVRQAPGKGLEWVGRIFPGDGDTDYNGKFKGRVTITADKSTSTAYMELSSLRSEDTAVYYCARNVFDGYWLVYWGQGTLVTVSS

SEQ ID NO: 852 - protein, 119 aa, Artificial Sequence
  Description of Artificial Sequence: Synthetic heavy chain variable domain
QVQLVESGGGLVKPGGSLRLSCAASGFTFSYSWMNWVRQAPGKGLEWVGRIFPGDGDTDYNGKFKGRVTITADKSTSTAYMELSSLRSEDTAVYYCARNVFDGYWLVYWGQGTLVTVSS

SEQ ID NO: 853 - protein, 119 aa, Artificial Sequence
  Description of Artificial Sequence: Synthetic heavy chain variable domain
EVQLVESGAGLVKPGGSLRLSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 854 - protein, 119 aa, Artificial Sequence
  Description of Artificial Sequence: Synthetic heavy chain variable domain
EVQLVESGGGVVKPGGSLRLSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 855 - protein, 119 aa, Artificial Sequence
  Description of Artificial Sequence: Synthetic heavy chain variable domain
EVQLVESGGGLKKPGGSLRLSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 856 - protein, 119 aa, Artificial Sequence
  Description of Artificial Sequence: Synthetic heavy chain variable domain
EVQLVESGGGLVKPGSSLRLSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 857 - protein, 119 aa, Artificial Sequence
  Description of Artificial Sequence: Synthetic heavy chain variable domain
EVQLVESGGGLVKPGGSLRVSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 858 - protein, 119 aa, Artificial Sequence
  Description of Artificial Sequence: Synthetic heavy chain variable domain
EVQLVESGGGLVKPGGSLRLSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 859 - protein, 119 aa, Artificial Sequence
  Description of Artificial Sequence: Synthetic heavy chain variable domain
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 860 - protein, 448 aa, Artificial Sequence
  Description of Artificial Sequence: Synthetic heavy chain variable domain
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 861 - protein, 222 aa, Artificial Sequence
  Description of Artificial Sequence: Synthetic heavy chain variable domain
EVQLVESGGGLVQPGRSLRLSCAASGFTFNDYAMHWVRQSPGKGLEWVSTISWNSGSIGYADSVKGRFTISRDNAKKSLYLQMNSLRAEDTAIYYCAKDIQYGNYYYGMDVWGQGTTVTVSSASTKGPSVFPLAPGSSKSTSGTAALGCLVKDYFPEPVTVSWNSGALTSGVHTFPAVLQSSGLYSLSSVVTVPSSSLGTQTYICNVNHKPSNTKVDKKVEP

SEQ ID NO: 862 - protein, 116 aa, Artificial Sequence
  Description of Artificial Sequence: Synthetic heavy chain variable domain
QVQLQESGAELSKPGASVKMSCKASGYTFTSYWLHWIKQRPGQGLEWIGYIYPRNDYTEYNQNFKDKATLTADKSSSTAYMQLSSLTSEDSAVYYCARRDITTFYWGQGTTLTVSS

SEQ ID NO: 863 - protein, 56 aa, Artificial Sequence
  Description of Artificial Sequence: Synthetic heavy chain variable domain
NQNFKDKATITADESTNTAYMELSSLRSEDTAFYFCARRDITTFYWGQGTTVTVSS

SEQ ID NO: 864 - protein, 123 aa, Artificial Sequence
  Description of Artificial Sequence: Synthetic heavy chain variable domain
EVQLVESGGGLVKPGGSLKLSCAASGFAFSIYDMSWVRQTPEKRLEWVAYISSGGGTTYYPDTVKGRFTISRDNAKNTLYLQMSSLKSEDTAMYYCARHSGYGSSYGVLFAYWGQGTLVTVSA

SEQ ID NO: 865 - protein, 123 aa, Artificial Sequence
  Description of Artificial Sequence: Synthetic heavy chain variable domain
QVQLVQSGAEVKKPGSSVKVSCKASGFTFSIYDMSWVRQAPGQGLEWVAYISSGGGTTYYPDTVKGRFTITADESTNTAYMELSSLRSEDTAFYFCARHSGYGSSYGVLFAYWGQGTLVTVSS

SEQ ID NO: 866 - protein, 106 aa, Artificial Sequence
  Description of Artificial Sequence: Synthetic heavy chain variable domain
PVQLVQSGAEVKKPGSSVKVSCKASGGTFSRSAIIWVRQAPGQGLEWMGGIVPMFGPPNYAQKFQGRVTITADESTNTAYMELSSLRSEDTAFYFCAGGYGIYSPE

SEQ ID NO: 867 - protein, 124 aa, Artificial Sequence
  Description of Artificial Sequence: Synthetic heavy chain variable domain
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSS

SEQ ID NO: 868 - protein, 235 aa, Artificial Sequence
  Description of Artificial Sequence: Synthetic heavy chain variable domain
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVSHKPSNTKVDKKVEPKSCDKTSGQAG

SEQ ID NO: 869 - protein, 127 aa, Artificial Sequence
  Description of Artificial Sequence: Synthetic heavy chain variable domain
EVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSS

SEQ ID NO: 870 - protein, 124 aa, Artificial Sequence
  Description of Artificial Sequence: Synthetic heavy chain variable domain
EVQLQQSGPGLVKPSQTLSLTCAISGDSVSNNNAAWNWIRQSPSRGLEWLGRTYHRSTWYNDYVGSVKSRITINPDTSKNQFSLQLNSVTPEDTAVYYCARETDYGDYGAFDIWGQGTTVTVSS

SEQ ID NO: 871 - protein, 121 aa, Artificial Sequence
  Description of Artificial Sequence: Synthetic heavy chain variable domain
EVQLQQSGPGLVNPSQTLSITCAISGDSVSSNSAAWNWIRQSPSRGLEWLGRTFYRSKWYNDYAVSVKGRITISPDTSKNQFSLQLNSVTPEDTAVYYCAGGDYYYGLDVWGQGTTVTVSS

SEQ ID NO: 872 - protein, 127 aa, Artificial Sequence
  Description of Artificial Sequence: Synthetic heavy chain variable domain
QVQLQESGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSS

SEQ ID NO: 873 - protein, 127 aa, Artificial Sequence
  Description of Artificial Sequence: Synthetic heavy chain variable domain
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSS

SEQ ID NO: 874 - protein, 127 aa, Artificial Sequence
  Description of Artificial Sequence: Synthetic heavy chain variable domain
EVQLQQSGPGLVKPSQTLPLTCAISGDSVLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 875 - protein, 127 aa, Artificial Sequence
  Description of Artificial Sequence: Synthetic heavy chain variable domain
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 876 - protein, 122 aa, Artificial Sequence
  Description of Artificial Sequence: Synthetic heavy chain variable domain
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTV

SEQ ID NO: 877 - protein, 124 aa, Artificial Sequence
  Description of Artificial Sequence: Synthetic heavy chain variable domain
QVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCASQSTPYDSSGYYSGDAFDIWGQGTMVTV

SEQ ID NO: 878 - protein, 123 aa, Artificial Sequence
  Description of Artificial Sequence: Synthetic heavy chain variable domain
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTV

SEQ ID NO: 879 - protein, 125 aa, Artificial Sequence
  Description of Artificial Sequence: Synthetic heavy chain variable domain
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGAYYCARDRLQDGNSWSDAFDVWGQGTMVTV

SEQ ID NO: 880 - protein, 120 aa, Artificial Sequence
  Description of Artificial Sequence: Synthetic heavy chain variable domain
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKGLSSWHFHDALDIWGQGTMVTV

SEQ ID NO: 881 - protein, 122 aa, Artificial Sequence
  Description of Artificial Sequence: Synthetic heavy chain variable domain
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTV

SEQ ID NO: 882 - protein, 119 aa, Artificial Sequence
  Description of Artificial Sequence: Synthetic heavy chain variable domain
EVQLQQSGPGLVKPSLTLSLTCAISGDSVSSNSATWTWIRQSPSRGLEWLGRTYYRSTWYNDYAVSVKSRITINPDTSKNQFSLQLNSVTPEDTAVYYCAREGSGSYYAYWGQGTLVTV

SEQ ID NO: 883 - protein, 120 aa, Artificial Sequence
  Description of Artificial Sequence: Synthetic heavy chain variable domain
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYWGYYGSGTLDYWGQGTLVTV

SEQ ID NO: 884 - protein, 126 aa, Artificial Sequence
  Description of Artificial Sequence: Synthetic heavy chain variable domain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGLALYSNYVPYYYYGMDVWGQGTTVTV

SEQ ID NO: 885 - protein, 114 aa, Artificial Sequence
  Description of Artificial Sequence: Synthetic heavy chain variable domain
EVQLVESGGGLVKPGGSLRLSCVASGFTFSNAWMNWVRQAPGKGLEWVGRIKSKTDGGTADYAAPVKGRFTISRDDSKNTMYLQMNSLKTEDTGVYYCITGATDVWGQGTTVTV

SEQ ID NO: 886 - protein, 125 aa, Artificial Sequence
  Description of Artificial Sequence: Synthetic heavy chain variable domain
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREESSSGWYEGNWFDPWGQGTLVTV

SEQ ID NO: 887 - protein, 125 aa, Artificial Sequence
  Description of Artificial Sequence: Synthetic heavy chain variable domain
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTV

SEQ ID NO: 888 - protein, 118 aa, Artificial Sequence
  Description of Artificial Sequence: Synthetic heavy chain variable domain
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGRMDTAMAQIWGQGTMVTV

SEQ ID NO: 889 - protein, 115 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLDVSLDIWGQGTMVTV

SEQ ID NO: 890 - protein, 121 aa, Artificial Sequence
  Description of Artificial Sequence: Synthetic heavy chain variable domain
EVQLVESGGGLVQPGGSLRLSCAASGFTFSSYAMHWVRQAPGKGLEYVSAISSNGGSTYYANSVKDRFTISRDNSKNTLYLQMGSLRAEDMAVYYCARVHSSGYYHPGPNDYWGQGTLVTV

SEQ ID NO: 891 - protein, 116 aa, Artificial Sequence
  Description of Artificial Sequence: Synthetic heavy chain variable domain
EVQLVESGAEVKKPGASVKVSCKASGYTFTSYYMHWVRQAPGQGLEWMGIINPSGGSTSYAQKFQGRVTMTRDTSTSTAYMELSSLRSEDTAVYYCAREAGVVAVDYWGQGTLVTV

SEQ ID NO: 892 - protein, 120 aa, Artificial Sequence
  Description of Artificial Sequence: Synthetic heavy chain variable domain
QVQLVQSGGGVVQPGRSLRLSCAASGFTFSSYAMSWVRQAPGKGLEWVSAISGSGGSTYYADSVKGRFTISRDNSKNTLYLQMNSLRAEDTAVYYCAKEPLFGVVEEDVDYWGQGTLVTV

SEQ ID NO: 893 - protein, 118 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSGSLGDAFDIWGQGTMVTV

SEQ ID NO: 894 - protein, 119 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGFGELSGAFDIWGQGTMVTV

SEQ ID NO: 895 - protein, 120 aa, Artificial Sequence
  Description of Artificial Sequence: Synthetic heavy chain variable domain
EVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGPIGCSGGSCLDYWGQGTLVTV

SEQ ID NO: 896 - protein, 119 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSYGDYGDAFDIWGQGTTVTV

SEQ ID NO: 897 - protein, 116 aa, Artificial Sequence
  Description of Artificial Sequence: Synthetic heavy chain variable domain
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARDHKVVRFGYWGQGTLVTV

SEQ ID NO: 898 - protein, 114 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGDYYMDVWGKGTTVTV

SEQ ID NO: 899 - protein, 122 aa, Artificial Sequence
  Description of Artificial Sequence: Synthetic heavy chain variable domain
EVQLVESGGGLVQPGGSLRLSCAASGFTFSSYAMSWVRQAPGKGLEWVSYISSSSSTIYYADSVKGRFTISRDNAKNSLYLQMNSLRAEDTAVYYCARDGPIRYFDHSKAFDIWGQGTMVTV

SEQ ID NO: 900 - protein, 117 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSISTAYMELSRLRSDDTAVYYCAREMDDSSGPDYWGQGTLVTV

SEQ ID NO: 901 - protein, 121 aa, Artificial Sequence
  Description of Artificial Sequence: Synthetic heavy chain variable domain
EVQLVESGAEVKKPGESLKISCKGSGYSFTGSWIGWGRQMPGKGLEWMGIIYPGDSDTRYSPSFQGQVTISADKSISTAYLQWSSLKASDTAMYYCARGFLRGGDCCGALDIWGQGTMVTV

SEQ ID NO: 902 - protein, 119 aa, Artificial Sequence
  Description of Artificial Sequence: Synthetic heavy chain variable domain
QVQLQESGPGLVKPSETLSLTCSVSGGSINSYYWSWIRQAPGKGLEWIAFTSHSGNVKYNPSLTGRVTIAVDTSKNQFYLEVTSVTAADTAVYFCARGLDPLFAYDAFEIWGLGTMVTV

SEQ ID NO: 903 - protein, 117 aa, Artificial Sequence
  Description of Artificial Sequence: Synthetic heavy chain variable domain
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDDFWSGSVDYWGQGTLVTV

SEQ ID NO: 904 - protein, 120 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREDDSSGYTSPFDYWGQGTLVTV

SEQ ID NO: 905 - protein, 123 aa, Artificial Sequence
  Description of Artificial Sequence: Synthetic heavy chain variable domain
EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREPASSSWYGYYYYMDVWGKGTLVTV

SEQ ID NO: 906 - protein, 120 aa, Artificial Sequence
  Description of Artificial Sequence: Synthetic heavy chain variable domain
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTV

SEQ ID NO: 907 - protein, 116 aa, Artificial Sequence
  Description of Artificial Sequence: Synthetic heavy chain variable domain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASFSSSDSYDYWGQGTLVTV

SEQ ID NO: 908 - protein, 125 aa, Artificial Sequence
  Description of Artificial Sequence: Synthetic heavy chain variable domain
QVNLRESGPALVKPTQTLTLTCTFSGFSLNTFGMSVSWIRQPPGKALEWLALIDWDDDKYYSTSLRTRLTISKDTAKNQVVLRMTNMDPMDTATYYCARIYGGDRTNTQAPYFFDLWGQGTLVTV

SEQ ID NO: 909 - protein, 120 aa, Artificial Sequence
  Description of Artificial Sequence: Synthetic heavy chain variable domain
QVQLQESGPGLVKPSGTLSLTCAVSGASITSRHWWNWVRHSPGKGLEWIGQIYHSGTTTYNPSLGSRVTISVDKSKNQISLELRSVTAADTATYYCVRDYLELATYYGMDVWGQGTTVTV

SEQ ID NO: 910 - protein, 122 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLAAAGNYYYYGMDVWGQGTTVTV

SEQ ID NO: 911 - protein, 120 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDDFWSGSGAFDIWGQGTTVTV

SEQ ID NO: 912 - protein, 121 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARPEGVSYYDSSVLDYWGQGTLVTV

SEQ ID NO: 913 - protein, 119 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSTSTVYMELSSLRAEDTAVYYCARGGYGDYLDAFDIWGQGTTVTV

SEQ ID NO: 914 - protein, 122 aa, Artificial Sequence
  Description of Artificial Sequence: Synthetic heavy chain variable domain
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSS

SEQ ID NO: 915 - protein, 117 aa, Artificial Sequence
  Description of Artificial Sequence: Synthetic heavy chain variable domain
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSS

SEQ ID NO: 916 - protein, 119 aa, Artificial Sequence
  Description of Artificial Sequence: Synthetic heavy chain variable domain
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSS

SEQ ID NO: 917 - protein, 125 aa, Artificial Sequence
  Description of Artificial Sequence: Synthetic heavy chain variable domain
EVQLVESGGGLVQPGGSLRLSCAASGFTFSTYAMNWVRQAPGKGLEWVGRIRSKYNNYATYYADSVKDRFTISRDDSKNSLYLQMNSLKTEDTAVYYCVRHGNFGNSYVSWFAYWGQGTLVTVSS

SEQ ID NO: 918 - protein, 125 aa, Artificial Sequence
  Description of Artificial Sequence: Synthetic heavy chain variable domain
EVQLVESGGGLVQPGGSLRLSCAASGFTFSTYAMNWVRQAPGKGLEWVGRIRSKYNNYATYYADSVKGRFTISRDDSKNSLYLQMNSLKTEDTAVYYCVRHGNFGNSYVSWFAYWGQGTLVTVSS

SEQ ID NO: 919 - protein, 192 aa, Artificial Sequence
  Description of Artificial Sequence: Synthetic heavy chain variable domain
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAKTTAPSVYPLAPVCGDTTGSSVTLGCLVKGYFPEPVTLTWNSGSLSSGVHTFPAVLQSDLYTLSSSVTVTSS

SEQ ID NO: 920 - protein, 125 aa, Artificial Sequence
  Description of Artificial Sequence: Synthetic heavy chain variable domain
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 921 - protein, 120 aa, Artificial Sequence
  Description of Artificial Sequence: Synthetic heavy chain variable domain
EVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSA

SEQ ID NO: 922 - protein, 119 aa, Artificial Sequence
  Description of Artificial Sequence: Synthetic heavy chain variable domain
VHQIQLVQSGAEVKKPGASVKVSCKASGYTFTDYYITWVRQAPGQGLEWMGWIYPGSGNTKYNEKFKGRVTMTRDTSISTAYMELSRLRSDDTAVYYCANYGNYWFAYWGQGTLVTVSS

SEQ ID NO: 923 - protein, 112 aa, Artificial Sequence
  Description of Artificial Sequence: Synthetic heavy chain variable domain
QVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSS

SEQ ID NO: 924 - protein, 116 aa, Artificial Sequence
  Description of Artificial Sequence: Synthetic heavy chain variable domain
DVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSA

SEQ ID NO: 925 - protein, 123 aa, Artificial Sequence
  Description of Artificial Sequence: Synthetic heavy chain variable domain
QVQLKESGPGLVAPSQSLSITCTVSGFSLSRYSVQWVRQPPGKGLEWLGMIWGGGSTDYNSGLKSRLTISKDNSKSQVFLKMNSLQTDDTAMYFCARTQFYYGHDGGYAMDFWGQGTSVTVSS

SEQ ID NO: 926 - protein, 120 aa, Artificial Sequence
  Description of Artificial Sequence: Synthetic heavy chain variable domain
DVQLVESGGGLVQPGGSRKLSCAASGFTFSSYGMHWVRQAPETGLEWVAYITTRSSTIYYAATVKGRFTISRDNARNTLFLQMTSLRSEDTAMYYCTREPLTGYYAMDYWGQGTSVTVSS

SEQ ID NO: 927 - protein, 123 aa, Artificial Sequence
  Description of Artificial Sequence: Synthetic heavy chain variable domain
QVQLKESGPGLVAPSQSLSITCTVSGFSLSRYSVHWVRQPPGKGLEWLGMIWGGGSIDYNSGLKSRLSISKDNSKSQVFLKMNSLQSDDTAMYHCVRAQFYYGYDGGYAMDYWGQGTSVTVSS

SEQ ID NO: 928 - protein, 118 aa, Artificial Sequence
  Description of Artificial Sequence: Synthetic heavy chain variable domain
SDVQLQESGPGLVKPSQSLSLTCTVTDYSITSDYAWNWIRQFPGNNLEWMGNIGYSGDTSYNPSLKSRISITRDTSKNQFFLQLNSVTTEDSATYYCARSSLGPFDYWGQGTALTVSS

SEQ ID NO: 929 - protein, 118 aa, Artificial Sequence
  Description of Artificial Sequence: Synthetic heavy chain variable domain
QVQLQQSGNELVRPGSAVKISCKASGYAFSSYWMNWVKQRPGQGLEWIGQIYPGDDDSNYNGKFKGKATLTADKSSSSAYMHLSSLTSEDSAVYFCARGFATPTMDYWGQGTSVTVSS

SEQ ID NO: 930 - protein, 119 aa, Artificial Sequence
  Description of Artificial Sequence: Synthetic heavy chain variable domain
QVQLQQSGAELMKTGASVKISCKATGYTFSSYWIEWVKQRPGHGLEWIGEILPGSGKTNYNENFKGKATFTADTSSNTAYMQLSSLTSEDSVVYYCARRGAYYGNFDYWGQGTTLTVSS

SEQ ID NO: 931 - protein, 123 aa, Artificial Sequence
  Description of Artificial Sequence: Synthetic heavy chain variable domain
QVQLKESGPGLVAPSQSLSITCTVTGFSLSRYSVHWIRQPPGKGLEWLGMIWGGGSTDYNSALKSRLSINKDNSKSQVFLKMNSLQTVDTAMYYCARTQFYYGHDGGYAMDYWGQGTSVTVSS

SEQ ID NO: 932 - protein, 116 aa, Artificial Sequence
  Description of Artificial Sequence: Synthetic heavy chain variable domain
EVQLQQSGPELLKPGASVKISCKASGYTFTDYNMHWVKQSHGKSLEWIGNIYPYNGGTGYNQKFKTKATLTVDNSSSTAYMELRSLTSEDSAVYYCAIGNYWFAFWGQGTLVTVSA

SEQ ID NO: 933 - protein, 120 aa, Artificial Sequence
  Description of Artificial Sequence: Synthetic heavy chain variable domain
EVQLQQSGPDLVKPGTSVKISCKASGYSFTACYIHWVKQSHGKSLEWIGRFSPNNDRTTYNQKFKDKAILTVDKSSSTAYMDLRSLTSEDSAVYYCARGEESWDAWFTYWGQGTLVTVSA

SEQ ID NO: 934 - protein, 119 aa, Artificial Sequence
  Description of Artificial Sequence: Synthetic heavy chain variable domain
QVTLKESGPGILQPSQTLSLTCSFSGFSLSTSGMGVGWIRQPSGKGLEWLAHIWWDDVKRYNPALKSRLTISKDTSSSQVFLKIASVDTADTATYHCARIAIGQPFAYWGQGTLVTVSA

SEQ ID NO: 935 - protein, 120 aa, Artificial Sequence
  Description of Artificial Sequence: Synthetic heavy chain variable domain
QVQLQQPGAELVKPGASVKLSCRTSGYSFTSYWIHWVKQRPGRGLEWIGRIVPNSGGTKYNENFKNKATLTVDKSSNTAYMQLSSLTSEDSAVYYCTREDSYGPFDLDYWGQGTSVTVSS

SEQ ID NO: 936 - protein, 121 aa, Artificial Sequence
  Description of Artificial Sequence: Synthetic heavy chain variable domain
EVQLQQSGPELVKPGASVKISCKASGYSFTGYFMNWVKQSHGKSLEWIGRINPYNGDNFYNQKFKGKATLTVDKSSSTAHMELLSLTSEDSAVYYCGRDYGSSYGWFFDVWGAGTTVTVSS

SEQ ID NO: 937 - protein, 123 aa, Artificial Sequence
  Description of Artificial Sequence: Synthetic heavy chain variable domain
EVQLQQSGPELVKPGASMKISCKASGYTFTDHTMHWVKQSHGKNLEWIGRINPYNGDTSHNQNFKGKATLTVDKSSNTAYMELLSLTSEDSAVYYCARYGGDYTSSYYTMDYWGQGTSSTVSS

SEQ ID NO: 938 - protein, 123 aa, Artificial Sequence
  Description of Artificial Sequence: Synthetic heavy chain variable domain
EVQLQQSGPELVKPGASMKISCKASGYTFTDYTMHWVRQSHGKNLEWIGRINPYNADTSHNQNFKGRATLTVDKSFNTAYMELLSLTSEDSAVYYCARYGGDFTSSYYTMDYWGQGTSVTVSS

SEQ ID NO: 939 - protein, 118 aa, Artificial Sequence
  Description of Artificial Sequence: Synthetic heavy chain variable domain
QVQLKESGPGLVAPSQSLSITCTVSGFSLTSYTISWVRQPPGKGLEWLGIIWTAGATNYNSALKSRLSISKDNSKSQVFLKMNSLQTDDTARYYCARYSKDYYAVDYWGQGTSVTVSS

SEQ ID NO: 940 - protein, 123 aa, Artificial Sequence
  Description of Artificial Sequence: Synthetic heavy chain variable domain
EVQLQQSGPELVKPGASMKISCKASGYTFTDYTMHWVKQSHGKNLEWIGRINPYNDDISHNQNFKDKATLTVDKSSNTAYMELLSLTSEDSAVYYCARYGGDYTSSYYTMDYWGQGTSVTVSS

SEQ ID NO: 941 - protein, 123 aa, Artificial Sequence
  Description of Artificial Sequence: Synthetic heavy chain variable domain
QVQLKESGPGLVAPSQSLSITCTVSGFSLSRYSVHWVRQPSGKGLEWLGMIWGGGSTDYNSALKSRLIISKDNSKSQVFLKMNSLQTDDTAMYYCARTQFYYGHDGGYAMDYWGQGTSVTVSS

SEQ ID NO: 942 - protein, 119 aa, Artificial Sequence
  Description of Artificial Sequence: Synthetic heavy chain variable domain
QVTLKESGPGILQPSQTLSLTCSFSGFSLSTSGMGVGWIRQPSGKGLEWLAHIWWDDVKRYNPALKSRLNISKDTSSSQVFLKIASVDTADTATYYCGRKSNSGYFDYWGQGTTLTVSS

SEQ ID NO: 943 - protein, 116 aa, Artificial Sequence
  Description of Artificial Sequence: Synthetic heavy chain variable domain
EVQLQQSGPDLVKPGASVKISCKASGYSFTGYFMNWVKQSHGKSLEWIGRINPYNGDTFYNQKFKGKATLTVDKSSSTAHMELLSLTSEDSAVYYCGRGNYYFDYWGQGTTLTVSS

SEQ ID NO: 944 - protein, 114 aa, Artificial Sequence
  Description of Artificial Sequence: Synthetic heavy chain variable domain
QVQLEQSGGDLVKPGGSLKLSCAASGFTFSSYGMSWVRQTPDKRLEWVATISSGGSYSYYPDSVKGRFTISRDNAKNTLYLQMSSLKSEDTAMYFCRPSFFPSWGQGTLVTVSA

SEQ ID NO: 945 - protein, 109 aa, Artificial Sequence
  Description of Artificial Sequence: Synthetic heavy chain variable domain
EVQLQQSGAELVRPGASVKLSCTASGFNINDDYFHWVKQRPEQGLEWIGRIDPANGNTKYGPKFQDKATITADTSSNTAYLQFTSLTSEDTAVYYCASGWAFACWGQGT

SEQ ID NO: 946 - protein, 123 aa, Artificial Sequence
  Description of Artificial Sequence: Synthetic heavy chain variable domain
EVQLQQSGPELVKPGTSMKISCKASGYTFTDYTMHWVKQSHGKNLEWIGRINPYTGSTSHNQNFKDKASLTVDKSSNTAYMDLLSLTSEDSAVYYCARFGGDYTSSYYTLDYWGQGTSVSVSS

SEQ ID NO: 947 - protein, 117 aa, Artificial Sequence
  Description of Artificial Sequence: Synthetic heavy chain variable domain
EVQLQQSGPELVKPGDSVKMSCKASGNTVTNYYMDWVKQSHGKSLEWIGYIYANNGGTSYNQKFKGKATLTVDKSSSTAYMEIHSLTSEDSAVYYCAIYYRYEFAYWGQGTLVTVSA

SEQ ID NO: 948 - protein, 121 aa, Artificial Sequence
  Description of Artificial Sequence: Synthetic heavy chain variable domain
SDVQLQESGPGLVKPSQSLSVTCTVTDYSLTSGYYWNWIRQFPGNKLEWMAYIHSSGSTHYNPSLKSRISVTRDTSKNQFFLQLNSVTTEDTATYYCARDGAYYSSWFPYWGQGTLVTVSA

SEQ ID NO: 949 - protein, 112 aa, Artificial Sequence
  Description of Artificial Sequence: Synthetic heavy chain variable domain
QILLVQSGPELKKPGETVKISCKANYTFTDYGMHWVKQAPGKGLKWMGWINPKTGVASYADDFKGRFAFSLETSASTAYLQINNLENEDTSIYFCARFFDYWGQGTTLTVSS

SEQ ID NO: 950 - protein, 116 aa, Artificial Sequence
  Description of Artificial Sequence: Synthetic heavy chain variable domain
EVKLEESGGGLVQPGGSMKLSCEASGFTFSDAWMDWVRQSPEKGLEWVAEIRNKAKNHATYYAESVIGRFTISRDDSKSSVYLQMNSLRAEDTGIYYCGALGLDYWGQGTTLTVSS

SEQ ID NO: 951 - protein, 115 aa, Artificial Sequence
  Description of Artificial Sequence: Synthetic heavy chain variable domain
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVS

SEQ ID NO: 952 - protein, 117 aa, Artificial Sequence
  Description of Artificial Sequence: Synthetic heavy chain variable domain
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSS

SEQ ID NO: 953 - protein, 120 aa, Artificial Sequence
  Description of Artificial Sequence: Synthetic heavy chain variable domain
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSS

SEQ ID NO: 954 - protein, 118 aa, Artificial Sequence
  Description of Artificial Sequence: Synthetic heavy chain variable domain
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSS

SEQ ID NO: 955 - protein, 121 aa, Artificial Sequence
  Description of Artificial Sequence: Synthetic heavy chain variable domain
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSS

SEQ ID NO: 956 - protein, 127 aa, Artificial Sequence
  Description of Artificial Sequence: Synthetic heavy chain variable domain
QVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSS

SEQ ID NO: 957 - protein, 125 aa, Artificial Sequence
  Description of Artificial Sequence: Synthetic heavy chain variable domain
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEDTIRGPNYYYYGMDVWGQGTTVTVSS

SEQ ID NO: 958 - protein, 121 aa, Artificial Sequence
  Description of Artificial Sequence: Synthetic heavy chain variable domain
QVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSS

SEQ ID NO: 959 - protein, 116 aa, Artificial Sequence
  Description of Artificial Sequence: Synthetic heavy chain variable domain
QVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSS

SEQ ID NO: 960 - protein, 120 aa, Artificial Sequence
  Description of Artificial Sequence: Synthetic heavy chain variable domain
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSS

SEQ ID NO: 961 - protein, 121 aa, Artificial Sequence
  Description of Artificial Sequence: Synthetic heavy chain variable domain
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSS

SEQ ID NO: 962 - protein, 121 aa, Artificial Sequence
  Description of Artificial Sequence: Synthetic heavy chain variable domain
QVQLVQSGAEVKKPGASVRVSCKASGYMFTDFFIHWVRQAPGQGLEWMGWINPNSGVTKYAQKFQGRVTMTRNTSISTAYMELSSLRSEDTAVYYCATWYSSGWYGIANIWGQGTMVTVSS

SEQ ID NO: 963 - protein, 120 aa, Artificial Sequence
  Description of Artificial Sequence: Synthetic heavy chain variable domain
QVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSS

SEQ ID NO: 964 - protein, 214 aa, Artificial Sequence
  Description of Artificial Sequence: Synthetic heavy chain variable domain
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 965 - protein, 451 aa, Artificial Sequence
  Description of Artificial Sequence: Synthetic heavy chain variable domain
VQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 966 - protein, 125 aa, Artificial Sequence
  Description of Artificial Sequence: Synthetic heavy chain variable domain
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 967 - protein, 444 aa, Artificial Sequence
  Description of Artificial Sequence: Synthetic heavy chain variable domain
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 968 - protein, 126 aa, Artificial Sequence
  Description of Artificial Sequence: Synthetic heavy chain variable domain
QVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 969 - protein, 113 aa, Artificial Sequence
  Description of Artificial Sequence: Synthetic heavy chain variable domain
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVS

SEQ ID NO: 970 - protein, 113 aa, Artificial Sequence
  Description of Artificial Sequence: Synthetic heavy chain variable domain
DIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGQGTKVEIKR

SEQ ID NO: 971 - protein, 120 aa, Artificial Sequence
  Description of Artificial Sequence: Synthetic heavy chain variable domain
QVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVS

SEQ ID NO: 972 - protein, 112 aa, Artificial Sequence
  Description of Artificial Sequence: Synthetic heavy chain variable domain
QIQLVQSGPELKKPGETVKISCKASGYAFTDFSMHWVKQAPGKGLRWMGWINTETGEPTYADDFKGRFAFSLETSASTAYLQIKNLKNEDTATYFCVRFAYWGQGTLVTVSA

SEQ ID NO: 973 - protein, 144 aa, Artificial Sequence
  Description of Artificial Sequence: Synthetic heavy chain variable domain
EVLLQQSGPELVKPGASVKIPCKASGYTFTDYNMDWVKQSHGKSLEWIGDINPNNGDTFYNQKFKGKATLTVHKSSSTAFMELRSLTSEDTAVYYCTRSKYDNYPWFAYWGQGTLVTVSAAKTTPPSVYPLAPGCGDTTGSSVT

SEQ ID NO: 974 - protein, 122 aa, Artificial Sequence
  Description of Artificial Sequence: Synthetic heavy chain variable domain
QIQLQQSGPELVKPGASVKISCKASGYTFTDYYINWVKQRPGQGLEWIGWIYPGSGNTRYNEKFKGKATLTVDTSSSTAVMQLSSLTSEDSAVYFCTRYYYAGRYDWYFDVWGARTTVTVSS

SEQ ID NO: 975 - protein, 122 aa, Artificial Sequence
  Description of Artificial Sequence: Synthetic heavy chain variable domain
EVQLQQSGAELVKPGASVKLSCTASGFNIKDTYMHWVKQRPEQGLEWIGRIDPANGNIKYDPKFQGKATITSDTSSNTAYLQLSSLTSEDTAVYYCAHPSYDYDRNYAMDVWGQGTSVTVSS

SEQ ID NO: 976 - protein, 130 aa, Artificial Sequence
  Description of Artificial Sequence: Synthetic heavy chain variable domain
EVQLVESGGGLVKPGGSLKLSCAASGFTFSDVYMYWVRQTPEKRLEWVATISDGGTYIYYPDSVKGRFTISRDNAKNNLYLQMSSLKSEDTAMVVCVRDIDYDTSVPWFAYWGQGTLVTVSAAKTTAPSV

SEQ ID NO: 977 - protein, 120 aa, Artificial Sequence
  Description of Artificial Sequence: Synthetic heavy chain variable domain
EVLLHQSGPELVKPGASVKIPCKASGYTFTDYNMDWVKQSHGKSLEWIGDINPNNGGTFYNQKFKGKATLTVHKSSSTAFMELRSLTSEDTAVYYCTRSKYDNYPWFAYWGQGTLVTVSA

SEQ ID NO: 978 - protein, 119 aa, Artificial Sequence
  Description of Artificial Sequence: Synthetic heavy chain variable domain
QVQLQQSGPELVKPGASVKLSCKASGYTFTNYDINWVKQRPGQGLEWIGWIYPRDGSFKYNEKFKGKATLTVDTSSSTAYMDLHSLTSEDSAVFFCAVSEDGYPWFPYWGQGTLVTVSA

SEQ ID NO: 979 - protein, 119 aa, Artificial Sequence
  Description of Artificial Sequence: Synthetic heavy chain variable domain
SQVQLKESGPGLVAPSQNLSITCTVSGFSLTSYDISWIRQPPGKGLEWLGVIWTDGGTNYNSAFMSRLSISKDNSKSQVFLKMNSLQTDDTAIYYCVRVYDGYPWFAYWGQGTLVTVSA

SEQ ID NO: 980 - protein, 112 aa, Artificial Sequence
  Description of Artificial Sequence: Synthetic heavy chain variable domain
QIQLVQSGPELKKPGETVKISCKASGYTFTDYSMHWVKQAPGKGLKWMGLINTETGEPAYADDFRGRLDFSLETSASTAYLQINNLKNEDTATYFCVRFAYWGHGTLVTVSA

SEQ ID NO: 981 - protein, 122 aa, Artificial Sequence
  Description of Artificial Sequence: Synthetic heavy chain variable domain
QVQLQQPGAELVRPGASVKLSCKASGYTFTAFWINWVKQRPGQGLEWIGNIYPSDSYTNYNQNFKDKATLTVDKSSSTAYMQLSSPTSEDSAVYYCARSDYYGSSYYALDYWGQGTSVTVSS

SEQ ID NO: 982 - protein, 119 aa, Artificial Sequence
  Description of Artificial Sequence: Synthetic heavy chain variable domain
EVQLQQFGAELVKPGASVKISCKASGYTFTDYNMDWVKQSPGKSLEWIGDIHPNYDTSTYNQKFKGKATLTVDKSSSTAYMELRSLTSEDTAVYYCAREVRRGYFFDFWGQGTTLTVSS

SEQ ID NO: 983 - protein, 115 aa, Artificial Sequence
  Description of Artificial Sequence: Synthetic heavy chain variable domain
QVQLQQPGAELVKPGASVKLSCQTSGVTFTSVWMHWVKQRPGQGLEWIGEINPSNGRTNVNEKFKTKATLTVDKSSTTAVIQLNSLTSEDSAVYYCARLRDYGGWGQGTLVTVSA

SEQ ID NO: 984 - protein, 120 aa, Artificial Sequence
  Description of Artificial Sequence: Synthetic heavy chain variable domain
EIQLQQTGPELVKPGASVKISCKASGYSFTDSIMLWVKQSHGKSLEWIGNINPYYGSTTYNLKFKGKATLTVDKSSSTAYMQLNSLTSEDSAVYYCARGLRGYGGYFDYWGQGTTLTVSS

SEQ ID NO: 985 - protein, 119 aa, Artificial Sequence
  Description of Artificial Sequence: Synthetic heavy chain variable domain
EVQLQQSGPVLVKPGASVRMSCKASGYTFTDYYMNWVKQSHGKSLEWIGVFNPYNGGTNYNQKFKGKATLTVDKSSSTAYMELNGLTSEDSAVYYCADGYYSYYAMDYWGQGTSLTVSS

SEQ ID NO: 986 - protein, 123 aa, Artificial Sequence
  Description of Artificial Sequence: Synthetic heavy chain variable domain
QIQLQQSGPELVKPGASVKISCKASGYTFTDYYINWVKQKPGQGLEWIGWIYPGSGNTKYNEKFKGKATLTVDTSSSTAYMQLSSLTSEDTAVYFCARLGYFYGSSSWYFDVWGAGTTVTVSS

SEQ ID NO: 987 - protein, 117 aa, Artificial Sequence
  Description of Artificial Sequence: Synthetic heavy chain variable domain
QVQLQQSGAELARPGASVKLSCKASDYTFTSYGISWVKQRTGQGLEWIGEIFPRSGNTYYNEKFKGKATLTADKSSSTAYMELRSLTSEDSAVYFCARGLGGAMDYWGQGTSVIVSS

SEQ ID NO: 988 - protein, 117 aa, Artificial Sequence
  Description of Artificial Sequence: Synthetic heavy chain variable domain
DVQLVESGGGLVQPGGSRKLSCAASGFTFSSFGMHWVRQAPEKGLEWVAYISSATSAIYYADTVKGRFTISRDNPTNTLFLQMTSLRSEDTAMYYCARKGNNYFDYWGQGTTLTVSS

SEQ ID NO: 989 - protein, 114 aa, Artificial Sequence
  Description of Artificial Sequence: Synthetic heavy chain variable domain
EVQLVESGGGLVKPGGSLKLSCAASGFTFSSFGMSWVRQTPEKRLEWVAAINNGGNTYYSDTVKGRFTISRDNAKNTLYLQMSSLRSADTALYYCARVVHFDVWGAGTTVTVSS

SEQ ID NO: 990 - protein, 116 aa, Artificial Sequence
  Description of Artificial Sequence: Synthetic heavy chain variable domain
QVQLVQSGGGVVQPGRSLRLACAASGLTVNNYAMHWVRQAPGKGLEWVAVISYDGNNKYYADSVKGRFTISRDNSKNTLYLQMNSLRAEDTAVYYCAKGGGYFDLWGRGTLVTVSS

SEQ ID NO: 991 - protein, 122 aa, Artificial Sequence
  Description of Artificial Sequence: Synthetic heavy chain variable domain
QVQLQESGGGLVQPGGSLRLSCAASGFTFSNYAMSWVRQAPGKGLEWVSTISGSGSSTFYVDSVKGRFTISRDNSKNTLYLQMNSLRAEDTAVYYCAQGLYSSGWANWFDPRGQGTLVTVSS

SEQ ID NO: 992 - protein, 121 aa, Artificial Sequence
  Description of Artificial Sequence: Synthetic heavy chain variable domain
QVQLQESGGGWQPGRSLRLSCAASGFTFSSYGMHWVRQAPGKGLEWVAVISYDGSNKYYADSVKGRFTISRDNSKNTLYLQMNSLRAEDTAVYYCAKVGLAAAGLDAFDIWGQGTTVTVSS

SEQ ID NO: 993 - protein, 115 aa, Artificial Sequence
  Description of Artificial Sequence: Synthetic heavy chain variable domain
QVQLVQSGGGWQPGRSLRLSCAASGFTFSSYAMHWVRQAPGKGLEWVAVISYDGSNKYYADSVKGRFTISRDTSTNTLYLQNSLRADDTAVYYCGRESSGSPGVWGQGTTVTVSS

SEQ ID NO: 994 - protein, 121 aa, Artificial Sequence
  Description of Artificial Sequence: Synthetic heavy chain variable domain
QVQLVESGGGLIQPGGSLRLSCAASGFTVSSNYMSWVRQAPGKGLEWVSVIYTDGSTYYADSVKGRFTISRDNSKNTLYLQNSLRAEDTAIYYCARDRGTSGYDWAWFDLWGQGTLVTVSS

SEQ ID NO: 995 - protein, 123 aa, Artificial Sequence
  Description of Artificial Sequence: Synthetic heavy chain variable domain
QVQLQESGGGLVQPGGSLRLSCAASGFTFSSYAMSWVRQAPGKGLEWVSAISGSGGSTYYADSVKGRFTISRDNSKNTLYMQMNSLRAEDTAVYYCAKDRYYYGSGKDAFDIWGRGTMVTVSS

SEQ ID NO: 996 - protein, 117 aa, Artificial Sequence
  Description of Artificial Sequence: Synthetic heavy chain variable domain
QVQLVESGGGLVQPGGSLGLSCAASGFTFSNYWMSWVRQAPGKGLEWVANVRQDGGQKYYVDSVKGRFTISRDNAKNSLYLQNSLRTEDTAVYFCVSQRNSGEHDYWGQGTLVTVSS

SEQ ID NO: 997 - protein, 121 aa, Artificial Sequence
  Description of Artificial Sequence: Synthetic heavy chain variable domain
EVQLVESGGGLVQPGGSLRLSCAASGFTFSDYYMSWIRQAPGKGLEWVSYISSSGSTIYYADSVKGRFTISRDNSKNTLYLQMNSLRAEDTAVYYCARDYGRIAAAGRHYWGQGTLVTVSS

SEQ ID NO: 998 - protein, 121 aa, Artificial Sequence
  Description of Artificial Sequence: Synthetic heavy chain variable domain
EVQLVESGGGLVQPGGSLRLSCAASGFTFSDYYMSWIRQAPGKGLEWVSYISSSGSTIYYADSVKGRFTISRDNSKNTLYLQMNSLRAEDTAVYYCARDYGRIAAAGRNYWGQGTLVTVSS

SEQ ID NO: 999 - protein, 116 aa, Artificial Sequence
  Description of Artificial Sequence: Synthetic heavy chain variable domain
QVQLVQSGGGVVQPGRSLRLACAASGFTVNNYAMHWVRQAPGKGLEWVAVISYDGNNKYYADSVKGRFTISRDNSKNTLYLQMNSLRAEDTAVYYCAKGGGYFDLWGRGTLVTVSS

SEQ ID NO: 1000 - protein, 120 aa, Artificial Sequence
  Description of Artificial Sequence: Synthetic heavy chain variable domain
QVQLEVSGGGVVQPGRSLRLSCAASGFTFSTYGMHWVRQAPGKGLEWLSFISYDGDEKYYADSVKGRFTISRDNSKNTLYLQMNSLRAEDTAVYWCAKASGYGMGILDYWGQGTLVTVSS

SEQ ID NO: 1001 - protein, 122 aa, Artificial Sequence
  Description of Artificial Sequence: Synthetic heavy chain variable domain
EVQLVESGGGLVQPGGSLRLSCAASGFTFSDYYMSWIRQAPGKGLEWVSYISSSGSTIYYADSVKGPRFTISRDNSKNTLYLQMNSLRAEDTAVYYCARDYGRIAAAGRRYWGQGTLVTVSS

SEQ ID NO: 1002 - protein, 121 aa, Artificial Sequence
  Description of Artificial Sequence: Synthetic heavy chain variable domain
QVQLQESGGGVVRPGGSLRLSCAASGFTFSDYYMSWIRQAPGKGLEWVSYISSSGSTIYYADSVKGRFTISRDNSKNTLYLQMNSLRAEDTAVYYCARDYGRIAAAGRHYWGQGTLVTVSS

SEQ ID NO: 1003 - protein, 127 aa, Artificial Sequence
  Description of Artificial Sequence: Synthetic heavy chain variable domain
QVQLQESGGGLVQPGGSLRLSCAASGFTFSSYWMSWVRQAPGKGLEWVADIKQDGSEKYYVDSVKGRFTISGDNAKNSLYLQMNSLRAEDTAVYYCAKDVGSTAINYVRAYTWFDPWGQGTLVTVSS

SEQ ID NO: 1004 - protein, 120 aa, Artificial Sequence
  Description of Artificial Sequence: Synthetic heavy chain variable domain
QVQLQESGGGWRPGGSLRLSCAASGFTFSDYYMSWIRQAPGKGLEWVSYISSSGSTIYYADSVKGRFTISRDNSKNTLYLQMNSLRAEDTAVYYCARDYGRIAAAGRHYWGQGTLVTVSS

SEQ ID NO: 1005 - protein, 120 aa, Artificial Sequence
  Description of Artificial Sequence: Synthetic heavy chain variable domain
EVQLVESGGGLVKPGGSLRLSCAASGFTFSDYYMSWIRQAPGKGLEWVSYISSSGSSIYYADSVKGRFTISRDNAKNSLYLQMNSLKAEDTAVYYCARDITDWGVSFDYWGQGTLVTVSS

SEQ ID NO: 1006 - protein, 122 aa, Artificial Sequence
  Description of Artificial Sequence: Synthetic heavy chain variable domain
EVQLVESGGGWQPGRSLRLSCAASGFTFSSYGMHWVRQAPGKGLEWVAVISYDGSNKYYADSVKGRFTISRDNSKNTLYLQMNSLRAEDTAEYYCAKVMGLAAAGLDAFDIWGQGTLVTVSS

SEQ ID NO: 1007 - protein, 117 aa, Artificial Sequence
  Description of Artificial Sequence: Synthetic heavy chain variable domain
EVQLVESGGGWQPGRSLRLSCAASGFTFSSFGMHWVRRAPGKGLEWVAVISYDGSNQYYADSVKGRFTISRDNSKNTLYLQAEDTAVYYCGSRPGGGYASGSTVAYWGQGTLVTVSS

SEQ ID NO: 1008 - protein, 125 aa, Artificial Sequence
  Description of Artificial Sequence: Synthetic heavy chain variable domain
GGAMDYWGQGTSVIVSSDIKMTQSPSSMYASLGERVTITCKASQDINSYLSWFHQKPGKSPKTLIYRANRLVDGVPSRFSGSGSGQDYSLTISSLEFEDMGIYYCLQYDDFPYTFGGGTKLEIKR

SEQ ID NO: 1009 - protein, 100 aa, Artificial Sequence
  Description of Artificial Sequence: Synthetic heavy chain variable domain
QVQLQQSGAELARPGASVKLSCKASDYTFTSYGISWVKQRTGQGLEWIGEIFPRSGNTYYNEKFKGKATLTADKSSSTAYMELRSLTSEDSAVVFCARGL

SEQ ID NO: 1010 - protein, 114 aa, Artificial Sequence; identical to SEQ ID NO: 989
  Description of Artificial Sequence: Synthetic heavy chain variable domain

SEQ ID NO: 1011 - protein, 151 aa, Artificial Sequence
  Description of Artificial Sequence: Synthetic heavy chain variable domain
MLLLVTSLLLCELPHPAFLLIPQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGP

SEQ ID NO: 1012 - protein, 143 aa, Artificial Sequence
  Description of Artificial Sequence: Synthetic heavy chain variable domain
MLLLVTSLLLCELPHPAFLLIPQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSS

SEQ ID NO: 1013 - protein, 150 aa, Artificial Sequence
  Description of Artificial Sequence: Synthetic heavy chain variable domain
MLLLVTSLLLCELPHPAFLLIPLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSS

SEQ ID NO: 1014 - protein, 117 aa, Artificial Sequence
  Description of Artificial Sequence: Synthetic heavy chain variable domain
EVQLVESGGGLVQPGGSLRLSCAASGFTFSDYYMSWVRQAPGKGLEWVGFIRNKANGYTTEYSASVKGRFTISRDDSKNSLYLQMNSLKTEDTAVYYCARYIWFDYWGQGTTVTVSS

SEQ ID NO: 1015 - protein, 117 aa, Artificial Sequence
  Description of Artificial Sequence: Synthetic heavy chain variable domain
EVQLVESGGGLVQPGGSLRLSCAASGFTFTDYYMSWVRQAPGKGLEWVGFIRNKANGYTTEYNASVKGRFTISRDDSKNSLYLQMNSLKTEDTAVYYCTRYIFFDYWGQGTTVTVSS

SEQ ID NO: 1016 - protein, 116 aa, Artificial Sequence
  Description of Artificial Sequence: Synthetic heavy chain variable domain
EVQLVESGGGLVQPGGSLRLSCAASGFTFTDYYMSWVRQAPGKGLEWVGFIRNKANGYTTEYNASVKGRFTISRDDSKNSLYLQMNSLKTEDTAVYYCRYIFFDYWGQGTTVTVSS

SEQ ID NO: 1017 - protein, 118 aa, Artificial Sequence
  Description of Artificial Sequence: Synthetic heavy chain variable domain
QVQLVESGGGVVQPGRSLRLSCAASGFIFSGYGMHWVRQAPGKGLEWVTVIWYDGSNKYYADSVKGRFTISRDNSKNTLYLQMNSLRAEDTAVYYCARDTGDRFFDYWGQGTLVTVSS

SEQ ID NO: 1018 - protein, 117 aa, Artificial Sequence
  Description of Artificial Sequence: Synthetic heavy chain variable domain
EVQLVESGGGLVKPGGSLKLSCAASGLTFSSYAMSWVRQTPEKRLEWVASISSGGFTYYPDSVKGRFTISRDNARNILYLQMSSLRSEDTAMYYCARDEVRGYLDVWGAGTTVTVSS

SEQ ID NO: 1019 - protein, 123 aa, Artificial Sequence
  Description of Artificial Sequence: Synthetic heavy chain variable domain
QVQLQESGAELVKPGASVKLSCKASGYTFTSYWMHWVKQRPGQGLEWIGKINPSNGRTNYNEKFKSKATLTVDKSSSTAYMQLSSLTSEDSAVYYCARGGVYYDLYYYALDYWGQGTTVTVSS

SEQ ID NO: 1020 - protein, 122 aa, Artificial Sequence
  Description of Artificial Sequence: Synthetic heavy chain variable domain
QVQLVESGGGVVQPGRSLRLSCAASGFTFSNYGIHWVRQAPGKGLEWVAVIWYDGSNKYYADSVKGRFTISRDNSKNTLYLQMNSLRAEDTAVYYCARDGGYSGYDSGFDYWGQGTLVTVSS

SEQ ID NO: 1021 - protein, 122 aa, Artificial Sequence
  Description of Artificial Sequence: Synthetic heavy chain variable domain
QVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSS

SEQ ID NO: 1022 - protein, 117 aa, Artificial Sequence
  Description of Artificial Sequence: Synthetic heavy chain variable domain
QIQLVQSGPEVKKPGETVKISCKASGYTFTNYGMNWVKQAPGKGLKWMGINTYTGEPTYADAFKGRFAFSLETSASTAYLQINNLKNEDTATYFCARDYGDYGMDYWGQGTSVTVSS

SEQ ID NO: 1023 - protein, 118 aa, Artificial Sequence
  Description of Artificial Sequence: Synthetic heavy chain variable domain
EVQLQESGTVLARPGASVKMSCKASGYTFTSYWMHWVKQRPGQGLEWIGAIYPGNSETGYNQNFKGKAKLTAVTSASTAYMDLSSLTNEDSAVYYCTRENWDPGFAFWGQGTLITVSA

SEQ ID NO: 1024 - protein, 118 aa, Artificial Sequence
  Description of Artificial Sequence: Synthetic heavy chain variable domain
QVQLVQSGAEVKKPGASVKVSCKASGYTFTSYWMHWVRQAPGQGLEWMGAIYPGNSETGYAQKFQGRVTMTRDTSTSTVYMELSSLRSEDTAVYYCARENWDPGFAFWGQGTLVTVSS

SEQ ID NO: 1025 - protein, 448 aa, Artificial Sequence
  Description of Artificial Sequence: Synthetic heavy chain variable domain
QVQLVQSGAEVKKPGASVKMSCKASGYTFTSYWMHWVRQAPGQGLEWIGAIYPGNSETGYAQKFQGRATLTADTSTSTAYMELSSLRSEDTAVYYCTRENWDPGFAFWGQGTLITVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1026 - protein, 118 aa, Artificial Sequence
  Description of Artificial Sequence: Synthetic heavy chain variable domain
QVQLVQSGAEVKKPGASVKMSCKASGYTFTSYWMHWVRQAPGQGLEWIGAIYPGNSETGYAQKFQGRATLTADTSTSTAYMELSSLRSEDTAVYYCTRENWDPGFAFWGQGTLVTVSS

SEQ ID NO: 1027 - protein, 118 aa, Artificial Sequence
  Description of Artificial Sequence: Synthetic heavy chain variable domain
QVQLVQSGAEVKKPGASVKMSCKASGYTFTSYWMHWVRQAPGQGLEWIGAIYPGNSETGYAQKFQGRATLTADTSTSTAYMELSSLRSEDTAVYYCTRENWDPGFAFWGQGTLITVSS

SEQ ID NO: 1028 - protein, 447 aa, Artificial Sequence
  Description of Artificial Sequence: Synthetic heavy chain variable domain
QVQLVQSGAEVKKPGASVKMSCKASGYTFTSYWMHWVRQAPGQGLEWIGAIYPGNSETGYAQKFQGRATLTADTSTSTAYMELSSLRSEDTAVYYCTRENWDPGFAFWGQGTLITVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1029 - protein, 121 aa, Artificial Sequence
  Description of Artificial Sequence: Synthetic heavy chain variable domain
QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS

SEQ ID NO: 1030 - protein, 121 aa, Artificial Sequence
  Description of Artificial Sequence: Synthetic heavy chain variable domain
QVQLVESGGGVVQPGRSLRLSCAASGFTFSNYGLHWVRQAPGKGLEWVAVIRYDGSNKYYADSVKGRFTISRDNSKNTLYLQMSSLRAEDTAVYYCARGGSSWYPDGLDVWGQGTTVTVSS

SEQ ID NO: 1031 - protein, 120 aa, Artificial Sequence
  Description of Artificial Sequence: Synthetic heavy chain variable domain
EFQLQQSGPELVKPGASVKVSCKASGYAFTSYNMYWVKQSHGKRLEWIGYIDPYNGGSSYNQKFKGKATLTVDKSSSTAYMHLNNLTSEDSAVYYCARGYNNYKAWFAYWGQGTLVTVSA

SEQ ID NO: 1032 - protein, 120 aa, Artificial Sequence
  Description of Artificial Sequence: Synthetic heavy chain variable domain
EIQLQQSGPELVKPGASVKVSCKASGYAFTSYNMYWVKQSHGKSLEWIGYIDPYNGGTSYNQKFKGKATLTVDKSSSTAYMHLNSLTSEDSAVYYCARGYGNYKAWFAYWGQGTLVTVSA

SEQ ID NO: 1033 - protein, 126 aa, Artificial Sequence
  Description of Artificial Sequence: Synthetic heavy chain variable domain
EVQLQQSGPELVKPGASVKVSCKASGYAFASYNMNWVKQSHGKSLDWIGYIDPYNGGSSYNLTFKGKATLTVDKSSTTAYMHLNSLTSEDSAVYYCARGYGNYKAWFAYWGQGTLVTVSAASTKGP

SEQ ID NO: 1034 - protein, 126 aa, Artificial Sequence
  Description of Artificial Sequence: Synthetic heavy chain variable domain
QIQLQQSGPELVKPGASVKVSCKASGYAFASYNMNWVKQSHGKSLDWIGYIDPYNGGSSYNLTFKGKATLTVDKSSTTAYMHLNSLTSEDSAVYYCARGYGNYKAWFAYWGQGTLVTVSAASTKGP

SEQ ID NO: 1035 - protein, 120 aa, Artificial Sequence
  Description of Artificial Sequence: Synthetic heavy chain variable domain
QIQLVQSGPELKKPGETVKVTCKTSGYTFTNYGVNWIKQTPGEGLQWMGWINPNTGEPTFDDDFKGRFAFSLESSASTAFLQISNLKNEDMGTYFCSRSRGKNEAWFAYWGQGTLVTVSE

SEQ ID NO: 1036 - protein, 120 aa, Artificial Sequence
  Description of Artificial Sequence: Synthetic heavy chain variable domain
QVQLQQSGPELKKPGETVKVTCKTSGYTFTNYGVNWIKQTPGEGLQWMGWINPNTGEPTFDDDFKGRFAFSLESSASTAFLQISNLKNEDMGTYFCSRSRGKNEAWFAYWGQGTLVTVSS

SEQ ID NO: 1037 - protein, 120 aa, Artificial Sequence
  Description of Artificial Sequence: Synthetic heavy chain variable domain
QVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSS

SEQ ID NO: 1038 - protein, 120 aa, Artificial Sequence; identical to SEQ ID NO: 1036
  Description of Artificial Sequence: Synthetic heavy chain variable domain

SEQ ID NO: 1039 - protein, 120 aa, Artificial Sequence
  Description of Artificial Sequence: Synthetic heavy chain variable domain
QVQLQQSGPELKKPGETVKVTCKTSGYTFTNYGVNWIKQTPGEGLQWMGWINPNTGEPTFDDDFTGRFAFSLESSASTAFLQISNLKNEDMGTYFCSRSRGKNEAWFAYWGQGTLVTVSS

SEQ ID NO: 1040 - protein, 120 aa, Artificial Sequence
  Description of Artificial Sequence: Synthetic heavy chain variable domain
QVQLQQSGSELKKPGASVKVSCKASGYTFTNYGVNWIKQAPGQGLQWMGWINPNTGEPTFDDDFTGRFAFSLDTSVSTAYLQISSLKADDTAVYFCSRSRGKNEAWFAYWGQGSLVTVSS

SEQ ID NO: 1041 - protein, 120 aa, Artificial Sequence
  Description of Artificial Sequence: Synthetic heavy chain variable domain
QVQLVQSGSELKKPGASVKVSCKASGYTFTSYAMNWVRQAPGQGLEWMGWINTNTGNPTYAQGFTGRFVFSLDTSVSTAYLQISSLKADDTAVYYCAREDSNGYKIFDYWGQGSLVTVSS

SEQ ID NO: 1042 - protein, 113 aa, Artificial Sequence
  Description of Artificial Sequence: Synthetic heavy chain variable domain
QVQLQQPGVELVRPGASVKLSCKASGYTFTTYWMNWVRQRPGQGLDWIGMIDPSDSETHYNQMFKDKATLTVDKSSSTAYIQLNSLTSEDSAVYYCSRSLAFWGQGTLVTVSA

SEQ ID NO: 1043 - protein, 113 aa, Artificial Sequence
  Description of Artificial Sequence: Synthetic heavy chain variable domain
EVQLVQSGAEVKKPGASVKVSCKASGYTFTTYWMNWVRQAPGQGLEWIGMIDPSDSETHYNQMFKDRATLTVDTSTSTAYLELSSLRSEDTAVYYCSRSLAFWGQGTLVTVSS

SEQ ID NO: 1044 - protein, 113 aa, Artificial Sequence
  Description of Artificial Sequence: Synthetic heavy chain variable domain
EVQLVQSGAEVKKPGASVKVSCKASGYTFTTYYMNWVRQAPGQGLEWIGMIDPSDSETHYNQKFQGRATLTVDTSTSTAYLELSSLRSEDTAVYYCSRSLAFWGQGTLVTVSS

SEQ ID NO: 1045 - protein, 113 aa, Artificial Sequence
  Description of Artificial Sequence: Synthetic heavy chain variable domain
EVQLVQSGAEVKKPGASVKVSCKASGYTFTTYWMNWVRQAPGQGLEWIGMIDPSDSETHYNQMFKDRATLTVDKSTSTAYLELSSLRSEDTAVYYCSRSLAFWGQGTLVTVSS

SEQ ID NO: 1046 - protein, 113 aa, Artificial Sequence
  Description of Artificial Sequence: Synthetic heavy chain variable domain
EVQLVQSGAEVKKPGASVKVSCKASGYTFTTYWMNWVRQAPGQGLEWIGMIDPSDSETHYNQMFKDRATITVDTSTSTAYLELSSLRSEDTAVYYCSRSLAFWGQGTLVTVSS

SEQ ID NO: 1047 - protein, 113 aa, Artificial Sequence
  Description of Artificial Sequence: Synthetic heavy chain variable domain
EVQLVQSGAEVKKPGASVKVSCKASGYTFTTYWMNWVRQAPGQGLEWIGMIDPSDSETHYNQMFKDRVTLTVDTSTSTAYLELSSLRSEDTAVYYCSRSLAFWGQGTLVTVSS

SEQ ID NO: 1048 - protein, 117 aa, Artificial Sequence
  Description of Artificial Sequence: Synthetic heavy chain variable domain
EVQLVESGGGLVQPGGSLRLSCAASGYTFSSYWIEWVRQAPGKGLEWVGEILPGGGDTNYNEIFKGRFTISADTSKNTAYLQMNSLRAEDTAVYYCTRRVPIRLDYWGQGTLVTVSS

SEQ ID NO: 1049 - protein, 119 aa, Artificial Sequence
  Description of Artificial Sequence: Synthetic heavy chain variable domain
EVQLVQSGAEVKKPGASVKVSCKASGYTFTNYYIHWVRQAPGQGLEWIGWIYPGDGNTKYNEKFKGRATLTADTSTSTAYLELSSLRSEDTAVYYCARDSYSNYYFDYWGQGTLVTVSS

SEQ ID NO: 1050 - protein, 119 aa, Artificial Sequence
  Description of Artificial Sequence: Synthetic heavy chain variable domain
EVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDGYSRYYFDYWGQGTLVTVSS

SEQ ID NO: 1051 - protein, 122 aa, Artificial Sequence
  Description of Artificial Sequence: Synthetic heavy chain variable domain
EVQLVESGGGLVQPGGSLRLSCAASGYSFTGYTMNWVRQAPGKDLEWVALINPYKGVSTYNQKFKDRFTISVDKSKNTAYLQMNSLRAEDTAVYYCARSGYYGDSDWYFDVWGQGTLVTVSS

SEQ ID NO: 1052 - protein, 113 aa, Artificial Sequence
  Description of Artificial Sequence: Synthetic heavy chain variable domain
QVQLQQPGAELVRPGASVKLSCKASGYTFTSYWMNWVKQRPGQGLEWIGMVDPSDSETHYNQMFKDKATLTVDKSSSTAYMQLSSLTSEDSAVYYCARAMGYWGQGTSVTVSS

SEQ ID NO: 1053 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRMAWGASVNFDYWGQGTLVTVSS

SEQ ID NO: 1054 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAGRAWGASVNFDYWGQGTLVTVSS

SEQ ID NO: 1055 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRGRAWGASVNFDYWGQGTLVTVSS

SEQ ID NO: 1056 - protein, 120 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARTAWGSSIFDYWGQGTLVTVSS

SEQ ID NO: 1057 - protein, 120 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARRAWGSSIFDYWGQGTLVTVSS

SEQ ID NO: 1058 - protein, 120 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARTARGSSIFDYWGQGTLVTVSS

SEQ ID NO: 1059 - protein, 120 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARRARGSSIFDYWGQGTLVTVSS

SEQ ID NO: 1060 - protein, 120 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRATAWGSSIFDYWGQGTLVTVSS

SEQ ID NO: 1061 - protein, 120 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRRTAWGSSIFDYWGQGTLVTVSS

SEQ ID NO: 1062 - protein, 120 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRATARGSSIFDYWGQGTLVTVSS

SEQ ID NO: 1063 - protein, 120 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRARARGSSIFDYWGQGTLVTVSS

SEQ ID NO: 1064 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRRAWGASVNFDYWGQGTLVTVSS

SEQ ID NO: 1065 - protein, 120 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRRTARGSSIFDYWGQGTLVTVSS

SEQ ID NO: 1066 - protein, 120 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGARAWGSSIFDYWGQGTLVTVSS

SEQ ID NO: 1067 - protein, 120 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRARAWGSSIFDYWGQGTLVTVSS

SEQ ID NO: 1068 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRMARGASVNFDYWGQGTLVTVSS

SEQ ID NO: 1069 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRRARGASVNFDYWGQGTLVTVSS

SEQ ID NO: 1070 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRGMAWGASVNFDYWGQGTLVTVSS

SEQ ID NO: 1071 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRRMAWGASVNFDYWGQGTLVTVSS

SEQ ID NO: 1072 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRGMARGASVNFDYWGQGTLVTVSS

SEQ ID NO: 1073 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRGRARGASVNFDYWGQGTLVTVSS

SEQ ID NO: 1074 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRRGARGASVNFDYWGQGTLVTVSS

SEQ ID NO: 1075 - protein, 121 aa, Artificial Sequence
  Description of Artificial Sequence: Synthetic heavy chain variable domain
QVQLVESGGGVVQPGRSLRLSCSSSGFALTDYYMSWVRQAPGKGLEWLGFIANKANGHTTDYSPSVKGRFTISRDNSKNTLFLQMDSLRPEDTGVYFCARDMGIRWNFDVWGQGTPVTVSS

SEQ ID NO: 1076 - protein, 112 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTIKYTPSLKARFTISRDNSKNTLYLQMNSLRAEDTAVYYCAGPAYWGQGTLVTVSS

SEQ ID NO: 1077 - protein, 112 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTIQYTPSLKARFTISRDNSKNTLYLQMNSLRAEDTAVYYCAGPAYWGQGTLVTVSS

SEQ ID NO: 1078 - protein, 112 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTINYNPSLKARFTISRDNSKNTLYLQMNSLRAEDTAVYYCAGPAYWGQGTLVTVSS

SEQ ID NO: 1079 - protein, 112 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTINYTPSLKARFTISRDNSKNTLYLQMNSLRAEDTAVYYCAGPAYWGQGTLVTVSS

SEQ ID NO: 1080 - protein, 112 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTIKYTPSLKARFTISRDNSKNTLYLQMNSLRAEDTAVYYCAGPAYWGQGTLVTVSS

SEQ ID NO: 1081 - protein, 112 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTIQYTPSLKARFTISRDNSKNTLYLQMNSLRAEDTAVYYCAGPAYWGQGTLVTVSS

SEQ ID NO: 1082 - protein, 112 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTINYNPSLKARFTISRDNSKNTLYLQMNSLRAEDTAVYYCAGPAYWGQGTLVTVSS

SEQ ID NO: 1083 - protein, 448 aa, Artificial Sequence
  Description of Artificial Sequence: Synthetic heavy chain variable domain
QVQLVQSGAEVKKPGASVKVSCKASGYTFTEYTLHWVRQAPGQRLEWMGGINPNNGDTIYNQKFKGRVTITRDTSASTAYMELSSLRSEDTAVYYCARRAITVYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1084 - protein, 451 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1085 - protein, 455 aa, Artificial Sequence
  Description of Artificial Sequence: Synthetic heavy chain variable domain
QVQLVQSGAEVKKPGASVKVSCKASGYTFTNYLIEWVRQAPGQGLEWMGLINPGSGGTNYNEKFKGRVTMTTDTSTSTAYMELRSLRSDDTAVYYCARRSPLGSWIYYAYDGVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1086 - protein, 441 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTINYTPSLKARFTISRDNSKNTLYLQMNSLRAEDTAVYYCTGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1087 - protein, 451 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1088 - protein, 451 aa, Artificial Sequence
  Description of Artificial Sequence: Synthetic heavy chain variable domain
QVQLVQSGAEVKKPGASVKVSCKASGYTFTSYWMNWVRQATGQGLEWMGMIHPSDSEIRLNQKFKDRVTMTRNTSISTAYMELSSLRSEDTAVYYCARIDSYYGYLFYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1089 - protein, 451 aa, Artificial Sequence
  Description of Artificial Sequence: Synthetic heavy chain variable domain
QVQLVQSGAEVKKPGASVKVSCKASGYTFTSYWMNWVRQAPGQGLEWMGMIHPSDSEIRLNQKFKDRVTMTRDTSTSTVYMELSSLRSEDTAVYYCARIDSYYGYLFYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1090 - protein, 451 aa, Artificial Sequence
  Description of Artificial Sequence: Synthetic heavy chain variable domain
QVQLVQSGAEVKKPGSSVKVSCKASGGTFSSYWMNWVRQAPGQGLEWMGMIHPSDSEIRLNQKFKDRVTITADESTSTAYMELSSLRSEDTAVYYCARIDSYYGYLFYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1091 - protein, 447 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 1092 - protein, 448 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLG

SEQ ID NO: 1093 - protein, 448 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 1094 - protein, 448 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVEGFYPSDIAVEWESNGQPENNYKTTPPVLDSDGSFFLYSKLTVDKSRWQEGNVFSCSVMHEALHNHYTQKSLSLSLG

SEQ ID NO: 1095 - protein, 448 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVEGFYPSDIAVEWESNGQPENNYKTTPPVLDSDGSFFLYSRLTVDKSRWQEGNVFSCSVMHEALHNHYTQKSLSLSLG

SEQ ID NO: 1096 - protein, 448 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVEGFYPSDIAVEWESNGQPENNYKTTPPVLDSDGSFFLYSRLTVDKSRWQEGNVFSCSVMHEALHNHYTQKSLSLSLG

SEQ ID NO: 1097 - protein, 448 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSSASTKGPSVFPLAPSSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 1098 - protein, 448 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSSASTKGPSVFPLAPSSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVEGFYPSDIAVEWESNGQPENNYKTTPPVLDSDGSFFLYSRLTVDKSRWQEGNVFSCSVMHEALHNHYTQKSLSLSLG

SEQ ID NO: 1099 - protein, 448 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSSASTKGPSVFPLAPSSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVEGFYPSDIAVEWESNGQPENNYKTTPPVLDSDGSFFLYSRLTVDKSRWQEGNVFSCSVMHEALHNHYTQKSLSLSLG

SEQ ID NO: 1100 - protein, 215 aa, Artificial Sequence
  Description of Artificial Sequence: Synthetic heavy chain variable domain
EIVLTQSPDFQSVTPKEKVTITCSVSSSISSSNLHWYQQKPDQSPKLWIYGTSNLASGVPSRFSGSGSGTDFTLTINSLEAEDAATYYCQQWSSYPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1101 - protein, 441 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTIKYTPSLKARFTISRDNSKNTLYLQMNSLRAEDTAVYYCTGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1102 - protein, 441 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTIQYTPSLKARFTISRDNSKNTLYLQMNSLRAEDTAVYYCTGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1103 - protein, 441 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTINYNPSLKARFTISRDNSKNTLYLQMNSLRAEDTAVYYCTGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1104 - protein, 441 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTINYTPSLKARFTISRDNSKNTLYLQMNSLRAEDTAVYYCTGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1105 - protein, 441 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTIKYTPSLKARFTISRDNSKNTLYLQMNSLRAEDTAVYYCTGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1106 - protein, 441 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTIQYTPSLKARFTISRDNSKNTLYLQMNSLRAEDTAVYYCTGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1107 - protein, 441 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTINYNPSLKARFTISRDNSKNTLYLQMNSLRAEDTAVYYCTGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1108 - protein, 441 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTINYTPSLKARFTISRDNSKNTLYLQMNSLRAEDTAVYYCAGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1109 - protein, 441 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTIKYTPSLKARFTISRDNSKNTLYLQMNSLRAEDTAVYYCAGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1110 - protein, 441 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTIQYTPSLKARFTISRDNSKNTLYLQMNSLRAEDTAVYYCAGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1111 - protein, 441 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTINYNPSLKARFTISRDNSKNTLYLQMNSLRAEDTAVYYCAGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1112 - protein, 441 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTINYTPSLKARFTISRDNSKNTLYLQMNSLRAEDTAVYYCAGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1113 - protein, 441 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTIKYTPSLKARFTISRDNSKNTLYLQMNSLRAEDTAVYYCAGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1114 - protein, 441 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTIQYTPSLKARFTISRDNSKNTLYLQMNSLRAEDTAVYYCAGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1115 - protein, 441 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTINYNPSLKARFTISRDNSKNTLYLQMNSLRAEDTAVYYCAGPAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1116 - protein, 119 aa, Artificial Sequence
  Description of Artificial Sequence: Synthetic heavy chain variable domain
EVQLQESRPELVKPGASVKISCKTSGYTFTEYTLHWVKQSHGKSLEWIGGINPNNGDTIYNQKFKGKATLTVDKSSSTAYMELRSLTSEYSAVYYCARRAITVYAMDYWGQGTSVTVSS

SEQ ID NO: 1117 - protein, 122 aa, Artificial Sequence
  Description of Artificial Sequence: Synthetic heavy chain variable domain
QVQLQQPGAELVRPGASVKLSCKASGYTFTSYWMNWVKQRPGQGLEWIAMIHPSDSEIRLNQKFKDKATLTVDRSSSTAYMQLSSPTSEDSAVYYCARIDSYYGYLFYFDYWGQGTTLTVSS

SEQ ID NO: 1118 - protein, 118 aa, Artificial Sequence
  Description of Artificial Sequence: Synthetic heavy chain variable domain
EVHLQQSGPELVKPGGSMKISCKASGYSFTGYTMNWVKQSHGKNLEWIGLFNPYNGGTSYNQKFKGKATLTVDKSSSTAYMELLSLTSEDSAVYYCARCYRYDGLDYWGQGTTLTVSS

SEQ ID NO: 1119 - protein, 118 aa, Artificial Sequence
  Description of Artificial Sequence: Synthetic heavy chain variable domain
EVQLQQSGPELVKPGASVKISCKTSGYTFTEYTVHWVKQSHGKSLEWIGGVYPKNGDTTYNQKFRGKATLTVDKSSNTAYMELRSLTSEDSAVYYCTGKDGYDGFAYWGQGTLVTVSA

SEQ ID NO: 1120 - protein, 123 aa, Artificial Sequence
  Description of Artificial Sequence: Synthetic heavy chain variable domain
EVQLQQSGPELVKPGASVKISCKASGYSFTGYYMNWVKQSPEKSLEWIGEINPSTGSTTYNQKFKAKATLTVDKSSSTAYMQLKSLTSEDSAVYYCARRDYYYGSGFYAMDYWGQGTSVTVSS

SEQ ID NO: 1121 - protein, 119 aa, Artificial Sequence
  Description of Artificial Sequence: Synthetic heavy chain variable domain
EVQLQQSGPELVKPGASVKISCKTSGYTFTEYTMHWVKQSHGKSLEWIGGINPNNGGTNYNQKFKGKATLTVDKSSSTAYMELRSLTSEDSAVYYCARRLITYYAMDYWGQGTSVTVSS

SEQ ID NO: 1122 - protein, 126 aa, Artificial Sequence
  Description of Artificial Sequence: Synthetic heavy chain variable domain
QVQMQQSGAELVRPGTSVKVSCKASGYAFTNYLIEWVKQRPGQGLEWIGLINPGSGGTNYNEKFKGKATLTADKSSTTAYMQLSSLTSDDSAVYFCARRSPLGSWIYYAYDGVAYWGQGTLVTVSA

SEQ ID NO: 1123 - protein, 120 aa, Artificial Sequence
  Description of Artificial Sequence: Synthetic heavy chain variable domain
EVQLQQSGPELVKPGASVKISCKTSGYTFTENIRHWVKQSRGKSLEWIGTINPNNGETRYNQKFKGKATLTVDKSSSTAYMELRSLTSEDSAVYYCTRGITKSPYGMDYWGQGTSITVSS

SEQ ID NO: 1124 - protein, 120 aa, Artificial Sequence
  Description of Artificial Sequence: Synthetic heavy chain variable domain
EVQLQQSGPELVKPGASVKISCKTSGYTFTENIIHWVKQSHGKSLEWIGGINPINGGTSYNQKFKGKATLTVDKSSSTAYMELRSLTSEDSAVYYCARGITTSPYAMDYWGQGTSVTVSS

SEQ ID NO: 1125 - protein, 112 aa, Artificial Sequence
  Description of Artificial Sequence: Synthetic heavy chain variable domain
EVKVLESGGGLVQPGGSLKLSCAASGFDFSRYWMSWVRQAPGKGLEWIGEINPDSSTINYTPSLKAKFIISRDNAKNTLYLQMSKVRSEDTALYYCTGPAYWGQGTLVTVSA

SEQ ID NO: 1126 - protein, 119 aa, Artificial Sequence
  Description of Artificial Sequence: Synthetic heavy chain variable domain
QVQLVQSGAEVKKPGASVKVSCKASGYTFTEYTLHWVRQAPGQRLEWMGGINPNNGDTIYNQKFKGRVTITRDTSASTAYMELSSLRSEDTAVYYCARRAITVYAMDYWGQGTLVTVSS

SEQ ID NO: 1127 - protein, 122 aa, Artificial Sequence
  Description of Artificial Sequence: Synthetic heavy chain variable domain
QVQLVQSGAEVKKPGASVKVSCKASGYTFTSYWMNWVRQAPGQRLEWMGMIHPSDSEIRLNQKFKDRVTITRDTSASTAYMELSSLRSEDTAVYYCARIDSYYGYLFYFDYWGQGTTVTVSS

SEQ ID NO: 1128 - protein, 126 aa, Artificial Sequence
  Description of Artificial Sequence: Synthetic heavy chain variable domain
QVQLVQSGAEVKKPGASVKVSCKASGYTFTNYLIEWVRQAPGQGLEWMGLINPGSGGTNYNEKFKGRVTMTTDTSTSTAYMELRSLRSDDTAVYYCARRSPLGSWIYYAYDGVAYWGQGTLVTVSS

SEQ ID NO: 1129 - protein, 112 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTINYTPSLKARFTISRDNSKNTLYLQMNSLRAEDTAVYYCTGPAYWGQGTLVTVSS

SEQ ID NO: 1130 - protein, 122 aa, Artificial Sequence
  Description of Artificial Sequence: Synthetic heavy chain variable domain
QVQLVQSGAEVKKPGASVKVSCKASGYTFTSYWMNWVRQATGQGLEWMGMIHPSDSEIRLNQKFKDRVTMTRNTSISTAYMELSSLRSEDTAVYYCARIDSYYGYLFYFDYWGQGTTVTVSS

SEQ ID NO: 1131 - protein, 122 aa, Artificial Sequence
  Description of Artificial Sequence: Synthetic heavy chain variable domain
QVQLVQSGAEVKKPGASVKVSCKASGYTFTSYWMNWVRQAPGQGLEWMGMIHPSDSEIRLNQKFKDRVTMTRDTSTSTVYMELSSLRSEDTAVYYCARIDSYYGYLFYFDYWGQGTTVTVSS

SEQ ID NO: 1132 - protein, 122 aa, Artificial Sequence
  Description of Artificial Sequence: Synthetic heavy chain variable domain
QVQLVQSGAEVKKPGSSVKVSCKASGGTFSSYWMNWVRQAPGQGLEWMGMIHPSDSEIRLNQKFKDRVTITADESTSTAYMELSSLRSEDTAVYYCARIDSYYGYLFYFDYWGQGTTVTVSS

SEQ ID NO: 1133 - protein, 112 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTIKYTPSLKARFTISRDNSKNTLYLQMNSLRAEDTAVYYCTGPAYWGQGTLVTVSS

SEQ ID NO: 1134 - protein, 112 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTIQYTPSLKARFTISRDNSKNTLYLQMNSLRAEDTAVYYCTGPAYWGQGTLVTVSS

SEQ ID NO: 1135 - protein, 112 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTINYNPSLKARFTISRDNSKNTLYLQMNSLRAEDTAVYYCTGPAYWGQGTLVTVSS

SEQ ID NO: 1136 - protein, 112 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTINYTPSLKARFTISRDNSKNTLYLQMNSLRAEDTAVYYCTGPAYWGQGTLVTVSS

SEQ ID NO: 1137 - protein, 112 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTIKYTPSLKARFTISRDNSKNTLYLQMNSLRAEDTAVYYCTGPAYWGQGTLVTVSS

SEQ ID NO: 1138 - protein, 112 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTIQYTPSLKARFTISRDNSKNTLYLQMNSLRAEDTAVYYCTGPAYWGQGTLVTVSS

SEQ ID NO: 1139 - protein, 112 aa, Artificial Sequence
  Description of Artificial Sequence: Synthetic heavy chain variable domain
EVQLLESGGGLVQPGGSLRLSCAASGFDFSRYWMSWVRQAPGKGLEWVSEINPDSSTINYNPSLKARFTISRDNSKNTLYLQMNSLRAEDTAVYYCTGPAYWGQGTLVTVSS

SEQ ID NO: 1140 - protein, 112 aa, Artificial Sequence
  Description of Artificial Sequence: Synthetic heavy chain variable domain
EVQLLESGGGLVQPGGSLRLSCAASGFTFSRYWMSWVRQAPGKGLEWVSEINPDSSTINYTPSLKARFTISRDNSKNTLYLQMNSLRAEDTAVYYCAGPAYWGQGTLVTVSS

SEQ ID NO: 1141 - protein, 115 aa, Artificial Sequence
  Description of Artificial Sequence: Synthetic heavy chain variable domain
QVQLQESGPGLVKPSETLSLTCVVSGGSISSSNWWSWVRQPPGKGLEWIGEIYHSGSPNYNPSLKSRVTISVDKSKNQFSLKLSSVTAADTAVYYSSSGGFFDYWGQGTLVTVSS

SEQ ID NO: 1142 - protein, 118 aa, Artificial Sequence
  Description of Artificial Sequence: Synthetic heavy chain variable domain
QVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSS

SEQ ID NO: 1143 - protein, 118 aa, Artificial Sequence
  Description of Artificial Sequence: Synthetic heavy chain variable domain
QVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSS

SEQ ID NO: 1144 - protein, 120 aa, Artificial Sequence
  Description of Artificial Sequence: Synthetic heavy chain variable domain
EVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSS

SEQ ID NO: 1145 - protein, 120 aa, Artificial Sequence
  Description of Artificial Sequence: Synthetic heavy chain variable domain
EVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSS

SEQ ID NO: 1146 - protein, 122 aa, Artificial Sequence
  Description of Artificial Sequence: Synthetic heavy chain variable domain
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARDPYSSSWHDAFDIWGQGTMVTVSS

SEQ ID NO: 1147 - protein, 120 aa, Artificial Sequence
  Description of Artificial Sequence: Synthetic heavy chain variable domain
EVQLQQSGPELVKPGASMKISCKASGYSFTGYTMNWVKQSHEKNLEWIGPINPYNDGTIYNPNFKGKATLTVDKASSTAYMELLSLTSDDPAVYYCARTDDYDDYTMDYWGQGTSVTVSS

SEQ ID NO: 1148 - protein, 121 aa, Artificial Sequence
  Description of Artificial Sequence: Synthetic heavy chain variable domain
QVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSS

SEQ ID NO: 1149 - protein, 119 aa, Artificial Sequence
  Description of Artificial Sequence: Synthetic heavy chain variable domain
EVQLQQSGPELVKPGASVKMSCKASGYIFTSYVMYWVKQKPGQGLEWIGYINPYNDGTKYNEKFKGKATLTSDKSSSTAYMELSSLTSEDSAVYYCARYYDYDYYFDYWGQGTTLTVSS

SEQ ID NO: 1150 - protein, 120 aa, Artificial Sequence
  Description of Artificial Sequence: Synthetic heavy chain variable domain
EVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSS

SEQ ID NO: 1151 - protein, 115 aa, Artificial Sequence
  Description of Artificial Sequence: Synthetic heavy chain variable domain
EVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSS

SEQ ID NO: 1152 - protein, 117 aa, Artificial Sequence
  Description of Artificial Sequence: Synthetic heavy chain variable domain
QVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFCARVYNWHFDVWGAGTTVTVSS

SEQ ID NO: 1153 - protein, 120 aa, Artificial Sequence
  Description of Artificial Sequence: Synthetic heavy chain variable domain
QVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSS

SEQ ID NO: 1154 - protein, 123 aa, Artificial Sequence
  Description of Artificial Sequence: Synthetic heavy chain variable domain
DIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSS

SEQ ID NO: 1155 - protein, 120 aa, Artificial Sequence
  Description of Artificial Sequence: Synthetic heavy chain variable domain
EVQLQQSGAEVKKPGSSVKVSCKASGGTFSSYAISWVRQAPGQGLEWMGGIIPIFGTANYAQKFQGRVTITADESTSTAYMELSSLRSEDTAVYYCARDLEMATIMGGYWGQGTLVTVSS

SEQ ID NO: 1156 - protein, 118 aa, Artificial Sequence
  Description of Artificial Sequence: Synthetic heavy chain variable domain
EVQLVESGGGVVQPGGSLRLSCAASGFTFDDYAMHWVRQAPGKGLEWVSLISGDGGSTYYADSVKGRFTISRDNSKNTLYLQMNSLRVEDTAVYYCARVFDSYYMDVWGKGTTVTVSS

SEQ ID NO: 1157 - protein, 125 aa, Artificial Sequence
  Description of Artificial Sequence: Synthetic heavy chain variable domain
QVQLQESGPGLVKPSETLSLTCTVSGGSISSSSYYWGWIRQPPGKGLEWIGSIYYSGSTYYNPSLKSRVSISVDTSKNQFSLKLKYVTAADTAVYYCATPGTYYDFLSGYYPFYWGQGTLVTVSS

SEQ ID NO: 1158 - protein, 116 aa, Artificial Sequence
  Description of Artificial Sequence: Synthetic heavy chain variable domain
QVQLVESGGGLVQPGGSLRLSCAASGFTFSSYWMSWVRQAPGKGLEWVANINEDGSAKFYVDSVKGRFTISRDNAKNSLYLQMNSLRAEDTAVYFCARDLRSGRYWGQGTLVTVSS

SEQ ID NO: 1159 - protein, 123 aa, Artificial Sequence
  Description of Artificial Sequence: Synthetic heavy chain variable domain
EVQLQQSGPGLVRPSETLSLTCTVSGGPVRSGSHYWNWIRQPPGRGLEWIGYIYYSGSTNYNPSLENRVTISIDTSNNHFSLKLSSVTAADTALYFCARGTATFDWNFPFDSWGQGTLVTVSS

SEQ ID NO: 1160 - protein, 126 aa, Artificial Sequence
  Description of Artificial Sequence: Synthetic heavy chain variable domain
QVQLQESGAGLLKPSETLSLTCAVYGGSFSGYYWSWIRQPPGKGLEWVGEINHSGSTNYNPSLKSRVTISVDTSKNQFSLKLSSVTAADTAVYYCARGSGLVVYAIRVGSGWFDYWGQGTLVTVSS

SEQ ID NO: 1161 - protein, 129 aa, Artificial Sequence
  Description of Artificial Sequence: Synthetic heavy chain variable domain
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSGSYYMEDSYYYGMDVWGQGTTVTVSS

SEQ ID NO: 1162 - protein, 117 aa, Artificial Sequence
  Description of Artificial Sequence: Synthetic heavy chain variable domain
QVNLRESGGGLVQPGGSLRLSCAASGFTFSSYEMNWVRQAPGKGLEWVSYISSSGSTIYYADSVKGRFTISRDNAKNSLYLQMNSLRAEDTAVYYCAREALGSSWEWGQGTTVTVSS

SEQ ID NO: 1163 - protein, 119 aa, Artificial Sequence
  Description of Artificial Sequence: Synthetic heavy chain variable domain
QVQLVQSGAEVKEPGASVKVSCKAPANTFSDHVMHWVRQAPGQRFEWMGYIHAANGGTHYSQKFQDRVTITRDTSANTVYMDLSSLRSEDTAVYYCARGGYNSDAFDIWGQGTMVTVSS

SEQ ID NO: 1164 - protein, 121 aa, Artificial Sequence
  Description of Artificial Sequence: Synthetic heavy chain variable domain
QVQLVQSGGGLVQPGGSLRLSCAASGFTFSSYSMNWVRQAPGKGLEWVSYISSSSSTIYYADSVKGRFTISRDNAKNSLYLQMNSLRAEDTAVYYCARDLSVRAIDAFDIWGQGTMVTVSS

SEQ ID NO: 1165 - protein, 119 aa, Artificial Sequence
  Description of Artificial Sequence: Synthetic heavy chain variable domain
EVQLVQSGGGVVRSGRSLRLSCAASGFTFNSYGLHWVRQAPGKGLEWVALIEYDGSNKYYGDSVKGRFTISRDKSKSTLYLQMDNLRAEDTAVYYCAREGNEDLAFDIWGQGTLVTVSS

SEQ ID NO: 1166 - protein, 127 aa, Artificial Sequence
  Description of Artificial Sequence: Synthetic heavy chain variable domain
QVQLVESGGGLVQPGGSLRLSCAASGFNVSSNYMTWVRQAPGKGLEWVSVIYSGGATYYGDSVKGRFTVSRDNSKNTVYLQMNRLTAEDTAVYYCARDRLYCGNNCYLYYYYGMDVWGQGTLVTVSS

SEQ ID NO: 1167 - protein, 120 aa, Artificial Sequence
  Description of Artificial Sequence: Synthetic heavy chain variable domain
QVQLVQSGAEVKKSGASVKVSCKASGYPFTGYYIQWVRQAPGQGLEWMGWIDPNSGNTGYAQKFQGRVTMTRNTSISTAYMELSSLRSEDTAVYYCASDSYGYYYGMDVWGQGTLVTVSS

SEQ ID NO: 1168 - protein, 122 aa, Artificial Sequence
  Description of Artificial Sequence: Synthetic heavy chain variable domain
QVQLQQSGPELVKPGASVKISCKASGYSFTDYYMHWVKQSHIKSLEWIGRINPYNGAAFYSQNFKDKASLTVDKSSSTAYMELHSLTSEDSAVYYCAIERGADLEGYAMDYWGQGTSVTVSS

SEQ ID NO: 1169 - protein, 122 aa, Artificial Sequence
  Description of Artificial Sequence: Synthetic heavy chain variable domain
EVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSS

SEQ ID NO: 1170 - protein, 122 aa, Artificial Sequence
  Description of Artificial Sequence: Synthetic heavy chain variable domain
EVQLVQSGAEVKKPGASVKVSCKASGYSFTDYYMHWVRQAPGQGLEWIGRINPYAGAAFYSQNFKDRVTLTVDTSTSTAYLELSSLRSEDTAVYYCAIERGADLEGYAMDYWGQGTLVTVSS

SEQ ID NO: 1171 - protein, 119 aa, Artificial Sequence
  Description of Artificial Sequence: Synthetic heavy chain variable domain
EVQLQQSGPELVKPGALVKISCKASGYTFTSYDINWLKQRPGQGLEWIGWIYPGDGTTEYNERFKGKATLTADKSSSTAYLQLSSLTSENSAVYFCARSYDYDYAMDYWGQGTSVTVSS

SEQ ID NO: 1172 - protein, 120 aa, Artificial Sequence
  Description of Artificial Sequence: Synthetic heavy chain variable domain
EVQLQQSGPELVKPGASVKMSCKASGYTFTDYYLDWVKQSHGESFEWIGRVNPYNGGTIYNQKFKGKATLTVDKSSSTAYMDLNSLTSEDSAVYYCARDHYRYDPLLDYWGQGTTLTVSS

SEQ ID NO: 1173 - protein, 120 aa, Artificial Sequence
  Description of Artificial Sequence: Synthetic heavy chain variable domain
EVQLVQSGAEVKKPGASVKVSCKASGYTFTDYYLDWVRQAPGQGLEWIGRVNPYNGGTIYNQKFKGRVTLTRDTSTSTAYLELSSLRSEDTAVYYCARDHYRYDPLLDYWGQGTLVTVSS

SEQ ID NO: 1174 - protein, 119 aa, Artificial Sequence
  Description of Artificial Sequence: Synthetic heavy chain variable domain
QVQLQQSGAELVKPGASVKLSCTASGFNIKDTYMHWVKQRPEQGLEWIGRIDPANGDTDYDPKFQGKATVTADTSSNTAYLQLSSLTSEDTAVYYCTISGPPYYVMDYWGQGTSVTVSS

SEQ ID NO: 1175 - protein, 122 aa, Artificial Sequence
  Description of Artificial Sequence: Synthetic heavy chain variable domain
  MOD_RES (55)..(55): Any amino acid
EVQLVQSGAEVKKPGASVKVSCKASGYSFTDYYMHWVRQAPGQGLEWIGRINPYXGAAFYSQNFKDRVTLTVDTSTSTAYLELSSLRSEDTAVYYCAIERGADLEGYAMDYWGQGTLVTVSS

SEQ ID NO: 1176 - protein, 122 aa, Artificial Sequence
  Description of Artificial Sequence: Synthetic heavy chain variable domain
EVQLVQSGAEVKKPGASVKMSCKASGYTFTSYFIHWVRQAPGQGLEWIGFINPYNKGSKYAQKFQGRATLTSDKSTSTVYMELSSLRSEDTAVYYCTRDDGYYGYAMDYWGQGTLVTVSSAS

SEQ ID NO: 1177 - protein, 120 aa, Artificial Sequence; identical to SEQ ID NO: 1144
  Description of Artificial Sequence: Synthetic heavy chain variable domain

SEQ ID NO: 1178 - protein, 120 aa, Artificial Sequence; identical to SEQ ID NO: 1145
  Description of Artificial Sequence: Synthetic heavy chain variable domain

SEQ ID NO: 1179 - protein, 120 aa, Artificial Sequence; identical to SEQ ID NO: 1147
  Description of Artificial Sequence: Synthetic heavy chain variable domain

SEQ ID NO: 1180 - protein, 121 aa, Artificial Sequence; identical to SEQ ID NO: 1148
  Description of Artificial Sequence: Synthetic heavy chain variable domain

SEQ ID NO: 1181 - protein, 119 aa, Artificial Sequence; identical to SEQ ID NO: 1149
  Description of Artificial Sequence: Synthetic heavy chain variable domain

SEQ ID NO: 1182 - protein, 120 aa, Artificial Sequence; identical to SEQ ID NO: 1150
  Description of Artificial Sequence: Synthetic heavy chain variable domain

SEQ ID NO: 1183 - protein, 115 aa, Artificial Sequence; identical to SEQ ID NO: 1151
  Description of Artificial Sequence: Synthetic heavy chain variable domain

SEQ ID NO: 1184 - protein, 117 aa, Artificial Sequence; identical to SEQ ID NO: 1152
  Description of Artificial Sequence: Synthetic heavy chain variable domain

SEQ ID NO: 1185 - protein, 121 aa, Artificial Sequence
  Description of Artificial Sequence: Synthetic heavy chain variable domain
QVQLQQPGAELVKPGASVKMSCKASGYTFTNYNMHWVKQTPGQGLEWIGAIFPGNGGTSYNQKFKGKATLTADKSSSTAYMQLTSLTSGDSAVYYCARWGYGSGLYAMDYWGQGTSVTVSS

SEQ ID NO: 1186 - protein, 117 aa, Artificial Sequence
  Description of Artificial Sequence: Synthetic heavy chain variable domain
EVQLQQSGPELVKPGASVKMSCKASGYTFTSYVMHWVKQKPGQGLEWIGYINPYNDGTKYNEKFKGKATLTSDKSSSTAYMELSSLTSEDSAVYYCARLRSRAMDYWGQGTSVTVSS

SEQ ID NO: 1187 - protein, 123 aa, Artificial Sequence
  Description of Artificial Sequence: Synthetic heavy chain variable domain
QVQLQQSGAELMKPGASVKISCKANGYTFSSYWIEWLRQRPGHGLEWIGEILPGSDNSNYNEKFKGKATFTADTSSNTAYMQLSSLTSEESAVYYCTRGLRRDGSYYYVMEHWGQGTSVTVSS

SEQ ID NO: 1188 - protein, 119 aa, Artificial Sequence
  Description of Artificial Sequence: Synthetic heavy chain variable domain
EVKLVESGGGLVKPGGSLKLSCAASGFTFGRYVMSWVRQTPEKKLEWVASITSGGTTYYPDSVKGRFTISRDNARNILYLQMSSLRSEDTAMYYCARVYYHYDDIFAYWGQGTLVTVSA

SEQ ID NO: 1189 - protein, 116 aa, Artificial Sequence
  Description of Artificial Sequence: Synthetic heavy chain variable domain
EVQLQQSGPELVKPGASVKISCKTSGYTFTEYTMHWVKQSHGKSLEWIGGINPNNGGTSYNQKFKGKATLTVDKSSSTAYMELRSLTSEDSAVYYCARGPAWFAYWGQGTLVTVSA

SEQ ID NO: 1190 - protein, 117 aa, Artificial Sequence
  Description of Artificial Sequence: Synthetic heavy chain variable domain
EVQLQQSGPELVKPGGSKKISCKASGYSFTGYSMNWVKQSHGKNLEWIGLINPYSGGTIYNQKFKGKATLTVDKSSSTAYMELLSLTSEDSAVYYCARRSDYPLVYWGQGTLVTVSA

SEQ ID NO: 1191 - protein, 117 aa, Artificial Sequence
  Description of Artificial Sequence: Synthetic heavy chain variable domain
QVQLKESGPVLVAPSQSLSITCTVSGFSLTSYGVHWVRQPPGKGLEWLGVIWAGGSTNYNSALMSRLSISKDNSKSQVFLKMNSLQTDDTAMYYCAKQGNFYAMDYWGQGTSVTVSS

SEQ ID NO: 1192 - protein, 121 aa, Artificial Sequence
  Description of Artificial Sequence: Synthetic heavy chain variable domain
EVQLQQSGPELVKPGASMKISCKASGYSFTGYTMNWVKQSHGKNLEWIGLINPYNGGTTYNQKFKGKATLTVDKSSSTAYMELLSLTSEDSAVYYCALGYYGNYRRYFDVWGAGTTVTVSS

SEQ ID NO: 1193 - protein, 119 aa, Artificial Sequence
  Description of Artificial Sequence: Synthetic heavy chain variable domain
QVQLQQSGAELARPGASVKLSCKASGYTCTSYWMQWVKQRPGQGLEWIGAIYPGDGDTRYTQKFKGKATLTADKSSSTAYMQLSSLASEDSAVYYCARGRRTEAWFAYWGQGTLVTVSA

SEQ ID NO: 1194 - protein, 120 aa, Artificial Sequence
  Description of Artificial Sequence: Synthetic heavy chain variable domain
QVTLKESGPGILQPSQTLSLTCSFSGFSLSTSGMGVGWIRQPSGKGLEWLAHIWWDDVKRYNPALKSRLTISKDASSSQVFLKIASVDTAETATYYCAHILDRAYYFDYWGQGTTLTVTS

SEQ ID NO: 1195 - protein, 118 aa, Artificial Sequence
  Description of Artificial Sequence: Synthetic heavy chain variable domain
QVTLKESGPGILKPSQTLSLTCSFSGFSLSTSGMIGWIRQPSGKGLEWLAHIWWDDDKYYNPSLKSQLTISKDSSRNQVFLKITSVDTADTATYYCARRGTAYYFDYWGQGTTLTVSS

SEQ ID NO: 1196 - protein, 115 aa, Artificial Sequence
  Description of Artificial Sequence: Synthetic heavy chain variable domain
QVQLKESGPDLVQPSQTLSLTCTVSGFSLTFYGVHWVRQPPGKGLEWVGTMGWDDKKYYNSALKSRLSISRDTSKNQVFLKLSSLQTEDTAMYYCTRGGTGFDYWGQGTTLTVSS

SEQ ID NO: 1197 - protein, 121 aa, Artificial Sequence
  Description of Artificial Sequence: Synthetic heavy chain variable domain
QVQLQQPGAELVKPGASVKLSCKASGYTFTSYWMHWVKQRPGQGLEWIGVINPSNGRTNYNEKFKSKATLTVDKSSSTAYMQLSSLTSEDSAVYYCARRRELGTLYAMDYWGQGTSVTVSS

SEQ ID NO: 1198 - protein, 115 aa, Artificial Sequence
  Description of Artificial Sequence: Synthetic heavy chain variable domain
QVQLKQSGPGLVAPSQSLFITCTVSGFSLTSYEINWVRQPPGKGLEWLGVIWTGGSTNYNSALISRLSISKDNSKSLVFLKMNSLQTDDTAIYYCVRGVYAMDYWGQGTSVTVSS

SEQ ID NO: 1199 - protein, 119 aa, Artificial Sequence
  Description of Artificial Sequence: Synthetic heavy chain variable domain
EVQLQQSGPELVKPGASVKMSCKASGYTFTNYVMHWVKQKPGQGLEWIGYINPYNDGTKYNEKFKGKATLTSDKSSTTAYMALSSLTSEDSAVYYCAVAYYSNWGFAYWGQGTLVTVSA

SEQ ID NO: 1200 - protein, 120 aa, Artificial Sequence
  Description of Artificial Sequence: Synthetic heavy chain variable domain
QVQLEESGAELARPGASVKLSCKASGYSYWMQWIKQRPGQGLEWIGAIYPGNGDTRYTQKFKGKATLTADKSSSTAYMQLSSLASEDSAVYYCARSPAYYRYGEGYFDYWGQGTTLTVSS

SEQ ID NO: 1201 - protein, 118 aa, Artificial Sequence
  Description of Artificial Sequence: Synthetic heavy chain variable domain
QIQLVQSGPELKKPGETVKISCKASGYTFTNYGMNWVKQAPGKGLKWMGWINTYTGEPAYADDFKGRFAFSLETSASAAYLQINNLKNEDTATFFCANMRPTRGFAYWGQGTLGTVSA

SEQ ID NO: 1202 - protein, 118 aa, Artificial Sequence
  Description of Artificial Sequence: Synthetic heavy chain variable domain
EVQLQQSGPGLVRTGASVKISCKASGYSFTGYYMHWVKQSHGKSLEWIGYISCYNGATTYNQNFKGKATFIVDTSSSTAYMQFNSLTSEDSAVYYCARSDGGHAMDYWGQGTSVTVSS

SEQ ID NO: 1203 - protein, 117 aa, Artificial Sequence
  Description of Artificial Sequence: Synthetic heavy chain variable domain
EVQLQQSGPELEKPGASVKISCKASGYSFTGYNMNWVKQSNGKSLEWIGNIDPYYGGSSYKQKFEGKATLTVDKSSSTAYMQLKSLTSEDSAVYYCARGGSNFFDYWGQGTTLTVSS

SEQ ID NO: 1204 - protein, 117 aa, Artificial Sequence
  Description of Artificial Sequence: Synthetic heavy chain variable domain
DVKLVESGGGLVKPGGSLKLSCAASGFTFSSYTMSWVRQTPEKRLEWVATISSGGSYPYYPDSVKGRFTISRDNAKNTLYLQMSSLKSEDTAMYYCTRDVYDGYSYWGQGTTLTVSS

SEQ ID NO: 1205 - protein, 123 aa, Artificial Sequence
  Description of Artificial Sequence: Synthetic heavy chain variable domain
EVQLQQSGAELVKPGASVKLSCTASGFNIKDTYIHWVKQRPEQGLEWIGRIDPANGNTKYDPKFQGKATITPDTSSNTAYLQLSSLTSEDTAVYYCARSWRNYGSSFWYFDVWGAGTTVTVSS

SEQ ID NO: 1206 - protein, 119 aa, Artificial Sequence
  Description of Artificial Sequence: Synthetic heavy chain variable domain
QVQLKQSGPGRVQPSQSLSITCTVSGFSLTSNGVVHWVRQSPGKGLEWLGVLWSGGSTDYNAAFISRLSISKDNYKSQVFFKMNSLQANDTAIYYCARNNNRYGAMDYWGQGTSVTVSS

SEQ ID NO: 1207 - protein, 117 aa, Artificial Sequence
  Description of Artificial Sequence: Synthetic heavy chain variable domain
QVQLKESGPGLVAPSQSLSIPCTVSGFSLTNYGVHWVRQPPGKGLEWLGVIWAGGITNYNSALMSRLSISEDNSKSQVFLKMNSLQTDDTAMYYCARNLGPYAMDYWGQGTSVTVSS

SEQ ID NO: 1208 - protein, 117 aa, Artificial Sequence
  Description of Artificial Sequence: Synthetic heavy chain variable domain
EVQLQQSGPDLVKPGASVKISCKASGYSFTGYYMHWVKQSHGKSLEWIGRVNPNNGGTSYNQKFKGKAILTADKSSSTAYMELRSLTSEDSAVYYCARGSYDYAEGWGQGTLVTVSA

SEQ ID NO: 1209 - protein, 117 aa, Artificial Sequence
  Description of Artificial Sequence: Synthetic heavy chain variable domain
EIQLQQSGPELVKPGASVKVSCKASGYAFTSYNMYWVMQSHGKSLEWIGYVDPYNGGTSYNQKFKGKATLTVDKSSSTAYMHLNSLTSEDSAVYYCARENYRYFDYWGQGTTLTVSS

SEQ ID NO: 1210 - protein, 124 aa, Artificial Sequence
  Description of Artificial Sequence: Synthetic heavy chain variable domain
EVQLVESGGGLVQPKGSLKLSCAASGFTFNTYAMNWVRQAPGKGLEWVARIRIKSNNYATYYADSVKDRFTISRDDSQNMLYLQMNNLKTEDTAVYYCVRQGYSYDWGPWFAYWGQGTLVTVSA

SEQ ID NO: 1211 - protein, 118 aa, Artificial Sequence
  Description of Artificial Sequence: Synthetic heavy chain variable domain
EVQLVESGGGLVKPGGSLKLSCAASGFTFSDYYMFWVRQTPEKRLEWVATISDGGSYTYFPDSVKGRFTISRDNAQNNLYLQMSSLKSEDTAMYYCARAGTLYAMDYWGQGTSVTVSS

SEQ ID NO: 1212 - protein, 122 aa, Artificial Sequence
  Description of Artificial Sequence: Synthetic heavy chain variable domain
QVALKESGPGILQPSQTLSLTCSFSGFSLSTSGMGVGWIRQPSGKGLEWLAHIWWDDVKRYNPALKSRLTISKDTSSSQVFLKIASVDTADTATYYCARMEDYGSSSYFDFWGHGTTLTVSS

SEQ ID NO: 1213 - protein, 123 aa, Artificial Sequence
  Description of Artificial Sequence: Synthetic heavy chain variable domain
EVQLQQSGPELVKPGASVKMSCKASGYTFTSYVMHWVKQKPGQGLEWIGYINPYNDGTKYNEKFKGKATLTSDKSSSTAYMELSSLTSEDSAVYYCARGALYYGNYLGYFDVWGAGTTVTVSS

SEQ ID NO: 1214 - protein, 118 aa, Artificial Sequence
  Description of Artificial Sequence: Synthetic heavy chain variable domain
SDVQLQESGPDLVKPSQSLSLTCTVTGYSITSGYSWHWIRQFPGNKLEWMGYIHYSGSTNYNPSLKSRISITRDTSKNQFFLQFKSVTTEDSATYYCALEGNYDGFAYWGQGTLVTVS

SEQ ID NO: 1215 - protein, 116 aa, Artificial Sequence
  Description of Artificial Sequence: Synthetic heavy chain variable domain
QVQMKESGPGLVAPSQSLSITCTVSGSSLTNYGVHWVRQPPGKGLEWLGVIWAGGSTNYNSALMSRLSISKDNSKSQVFLKMNSLQTDDTAMYYCARDWEGWFAYWGQGTLVTVSA

SEQ ID NO: 1216 - protein, 117 aa, Artificial Sequence
  Description of Artificial Sequence: Synthetic heavy chain variable domain
QVQLKESGPGLVAPSQSLSITCTVSSGFSLTDYGVSWIRQPPGKGLEWLGVIWGGGSTYYNSALKSRLSISKDNSKSQVFLELNSLQTDDTAIYYCAKHYGHYAAYWGQGTLVTVSA

SEQ ID NO: 1217 - protein, 120 aa, Artificial Sequence
  Description of Artificial Sequence: Synthetic heavy chain variable domain
EVQLQQSGPELVKPGASVKMSCKASGYTFTSYVMHWVKQKPGQGLEWIGYINPYNDGTEYNEKFKGKATLTSDKSSSTAYMELSSLTSEDSAVYYCARGVYDGYSYFDYWGQGTTLTVSS

SEQ ID NO: 1218 - protein, 118 aa, Artificial Sequence
  Description of Artificial Sequence: Synthetic heavy chain variable domain
QVQLKESGPGLVAPSQSLSITCTVSGFSLTNYGVVHWVRQPPGKGLEWLGVIWAGGITNYNSALMSRLSISEDNSKSQVFLKMNSLQTDDTAMYYCARNLGPYAMDYWGQGTSVTVSS

SEQ ID NO: 1219 - protein, 116 aa, Artificial Sequence
  Description of Artificial Sequence: Synthetic heavy chain variable domain
QVQLKESGPGLVAPSQSLSITCTVSGFSLTDYGVSWIRQPPGKGLEWLGVVWGGGSTYYNSALKSRLSITKDNSKSQVFLKMNSLQTDDTAMYYCAKQRGQYGAYWGQGTLVTVSA

SEQ ID NO: 1220 - protein, 119 aa, Artificial Sequence
  Description of Artificial Sequence: Synthetic heavy chain variable domain
QVQLKESGPGLVAPSQSLSITCTVSGFSLTNYAVHWVRQSPGKGLEWLGVIWSDGSTDYNAAFISRLSISKDNSKSQVFFKMNSLQADDTAMYYCARKKGGWFPWFAYWGQGTLVTVSA

SEQ ID NO: 1221 - protein, 117 aa, Artificial Sequence
  Description of Artificial Sequence: Synthetic heavy chain variable domain
EVQLQQSGPDLVKPGASVKISCKASGYSFTGYYMHWVKQSHGKRLEWIGRVNPNNGGTNYNQKFKGKAILTVDKSSSTAYMELRSLTSEDSAVYYCARGSYDNAEGWGQGTLVTVSA

SEQ ID NO: 1222 - protein, 121 aa, Artificial Sequence
  Description of Artificial Sequence: Synthetic heavy chain variable domain
QVQLQQSGAELVRPGTSVKVSCKASGYAFTNYLIEWVKQRPGQGLEWIGVINPGSGGTNSNEKFKAKATLTADKSSSTAYMQLSSLTSADSAVYFCARSDYDYAFYAMDYWGQGTSVTVSS

SEQ ID NO: 1223 - protein, 122 aa, Artificial Sequence
  Description of Artificial Sequence: Synthetic heavy chain variable domain
EFQLQQSGPELVKPGASVKMSCKASGYTFTSYVMHWVKQKPGQGLEWIGYINPYNDGTKYNEKFKGKATLTSDKSSSTAYMELSSLTSEDSAVYYCARDRSGYEDYYGMDYWGQGTSVTVSS

SEQ ID NO: 1224 - protein, 117 aa, Artificial Sequence
  Description of Artificial Sequence: Synthetic heavy chain variable domain
EVQLVESGGDLVKPGGSLKLSCAASGFTFSSYGMSWVRQTPDKRLEWVATISSGGSYTYYPDSVKGRFTISRDNAKNTLYLQMSSLKSEDTAMYYCARRRADAMDYWGQGTSVTVSS

SEQ ID NO: 1225 - protein, 116 aa, Artificial Sequence
  Description of Artificial Sequence: Synthetic heavy chain variable domain
QVQLKESGPGLVAPSQSLSITCTVSGFSLTDYGVSWIRQPPGKGLEWLGVVWGGGSTYYNSALKSRLSISKDNSKSQVFLKMNSLQTDDTAMYYCAKQRGQYGAYWGQGTLVTVSA

SEQ ID NO: 1226 - protein, 118 aa, Artificial Sequence
  Description of Artificial Sequence: Synthetic heavy chain variable domain
EVQLQQSGPELVKPGASVKMSCKASGYTFTNYVMHWVKQKPGQGLEWIGYINPYNDGTKYNEKFKGKATLTSDKSSTTAYMALSSLTSEDSAVYYAVAYYSNWGFAYWGQGTLVTVSA

SEQ ID NO: 1227 - protein, 116 aa, Artificial Sequence
  Description of Artificial Sequence: Synthetic heavy chain variable domain
QVQLQQSGPELVRPGASVKMSCKASGYTFTSYWMHWVKQRPGQGLEWIGMIDPSNSETRLNQKFKDKATLNVDKSSNTAYMQLSSLTSEDSAVYYCAVMDYYFDYWGQGTTLTVSS

SEQ ID NO: 1228 - protein, 115 aa, Artificial Sequence
  Description of Artificial Sequence: Synthetic heavy chain variable domain
EVQLQQSGPELVKPGASVKISCKASGYTFTDYNMHWVKQSHGKSLEWIGFFYPYNGNTVYSQKFKSKATLTVDNSSSTAYMELRSLTSEDSAVYYCARLNWEGYWGQGTTLTVSS

SEQ ID NO: 1229 - protein, 119 aa, Artificial Sequence
  Description of Artificial Sequence: Synthetic heavy chain variable domain
QVQLQQSGPELVKPGASVRISCKASGYTFTSYYIHWVKQRPGQGLEWIGWIYPGNGNTKYNEKFKGKATLTADKSSSTAYMQISSLTSEDSAVYFCARERWLLLWFAYWGQGTLVTVSA

SEQ ID NO: 1230 - protein, 118 aa, Artificial Sequence
  Description of Artificial Sequence: Synthetic heavy chain variable domain
QIQLVQSGPELKKPGETVKISCKASGYTFTNYGMNWVKQAPGKGLKWVGWINTYTGEPTYADDFKGRFAFSLETSASTAYLQIDNLKNEDTATYFCARVGDYVGFDYWGQGTTLTVSS

SEQ ID NO: 1231 - protein, 117 aa, Artificial Sequence
  Description of Artificial Sequence: Synthetic heavy chain variable domain
QIQLVQSGPELTKPGETVKISCKASGYTFTDYSLHWVKQALGKGLKWMGWINTETGEPAYADDFKGRFAFSLETSASTAYLQINDLKNEDTTTYFCGIYDGYAMDYWGQGTSVTVSS

SEQ ID NO: 1232 - protein, 118 aa, Artificial Sequence
  Description of Artificial Sequence: Synthetic heavy chain variable domain
QIQLVQSGPELKKPGETVKISCKASGYTLTNYGMNWVKQAPGKGLKWMGWINTYTGEPTYADDFKGRFAFSLETSARIVYLQINNLKNEDTATYFCAKYEAHEGFVYWGQGTLVTVSA

SEQ ID NO: 1233 - protein, 116 aa, Artificial Sequence
  Description of Artificial Sequence: Synthetic heavy chain variable domain
QVQLKESGPGLVAPSQSLSITCAVSGFSLTSFGVHWVRQPPGKGLEWLGVIWAGGSTNYYSALMSRLSISIDNSKSQVFLKMNSLQTDDTAMYYCARDWEGWFAYWGQGTLVTVSA

SEQ ID NO: 1234 - protein, 117 aa, Artificial Sequence
  Description of Artificial Sequence: Synthetic heavy chain variable domain
EIQLQQSGPELVKPGASVKVSCKASGYAFTSYNMYWVSQSHGKSLEWIGYIDPYNGGTSYNQKFRGKATLTVDKSSSTAYMHLNSLTSEDSAVYYCARENYRYFDFWGQGTTLTVSS

SEQ ID NO: 1235 - protein, 124 aa, Artificial Sequence
  Description of Artificial Sequence: Synthetic heavy chain variable domain
QITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSS

SEQ ID NO: 1236 - protein, 117 aa, Artificial Sequence
  Description of Artificial Sequence: Synthetic heavy chain variable domain
QVQLVQSGAEVKKPGASVKVSCKASGYTFTRYWIHWIRQAPGQGLEWMGYINPTTVYTEFNQNFKDRVTMTRDTSTSTVYMELSSLRSEDTAVYYCARGGSNFFDYWGQGTTVTVSS

SEQ ID NO: 1237 - protein, 125 aa, Artificial Sequence
  Description of Artificial Sequence: Synthetic heavy chain variable domain
QITLKESGPTLVKPTQTLTLTCTFSGFSLSTSGMGVGWIRQPPGKALEWLTDIWWDDNKYYNPSLKSRLTITKDTSKNQVVLTMTNMDPVDTATYYCARRVNYYYDPYYAMDYWGQGTTLVTVSS

SEQ ID NO: 1238 - protein, 123 aa, Artificial Sequence
  Description of Artificial Sequence: Synthetic heavy chain variable domain
QVTLKESGPGILQPSQTLSLTCSFSGFSLSTSGMGVGWIRQPSGKGLEWLAHIWWDDVKRYNPALKSRLTISKDTSSSQVFLKIASVDTADTATYYCARIADYGGDYYAMDYWGQGTSVTVSS

SEQ ID NO: 1239 - protein, 118 aa, Artificial Sequence
  Description of Artificial Sequence: Synthetic heavy chain variable domain
QVQLVQSGAEVKKPGASVKVSCKASGYTFTNYGMNWVRQAPGQRLEWMGWINTYTGDPTYADDFKGRVTITRDTSASTAYMELSSLRSEDTAVYYCARIGGNSPSDYWGQGTTVTVSS

SEQ ID NO: 1240 - protein, 118 aa, Artificial Sequence
  Description of Artificial Sequence: Synthetic heavy chain variable domain
QVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSS

SEQ ID NO: 1241 - protein, 117 aa, Artificial Sequence
  Description of Artificial Sequence: Synthetic heavy chain variable domain
QIQLVQSGPELKKPGETVKISCKASGYTFTDYSMHWVKQAPGKGLKWMGWINTETGEPGYADDFKGRFAFSLETSASTAYLQINNLKNEDTATYFCARYDGYAMDYWGQGTSVTVSS

SEQ ID NO: 1242 - protein, 124 aa, Artificial Sequence
  Description of Artificial Sequence: Synthetic heavy chain variable domain
QVTLKESGPGILQPSQTLSLTCSFSGFSLSTSGMGVGWIRQPSGEGLEWLADIWWDDNKYYNPSLKSRLTISKDTSSNQVFLKITSVDTADTATYYCARRVNYVYDPYYAMDYWGQGTSVTVSS

SEQ ID NO: 1243 - protein, 119 aa, Artificial Sequence
  Description of Artificial Sequence: Synthetic heavy chain variable domain
EVQLQQSGPELVKPGASVKISCKASGYSFTGYKMHWVKQSHVKSLEWIGRINPYNGATSYNQNFKDKATLTVDKSSSTAYMDLHSLTSEDSAVYFCARGDYRYDWFAYWGQGTLVTVSA

SEQ ID NO: 1244 - protein, 121 aa, Artificial Sequence
  Description of Artificial Sequence: Synthetic heavy chain variable domain
QAQLQQSGAELVRPGTSVKVSCKASGYAFTNYLIEWVKQRPGQGLEWIGVINPGTGGTNYNENFKGKATLTADKSSSTAYMQLSSLTSDDSAVYFCARSPYDYHEGAMDYWGQGTSVTVSS

SEQ ID NO: 1245 - protein, 120 aa, Artificial Sequence
  Description of Artificial Sequence: Synthetic heavy chain variable domain
QVTLKESGPGILQSSQTLSLTCSFSGFSLSTSGMGVGWIRQPSGKGLEWLAHIWWDDVKRYNPVLKSRLTISKDTSSSQVFLKIASVDTADTATYYCARLVDDLYYFDYWGQGTTLTVSS

SEQ ID NO: 1246 - protein, 117 aa, Artificial Sequence
  Description of Artificial Sequence: Synthetic heavy chain variable domain
QIQLVQSGPELKKPGETVKISCKASGYTFTDYSMHWVKQAPGKGLKWMGWINTETVEPTYADDFMGRFAFSLETSASTAFLQINNLENEDTATYFCARFGSYAMDYWGQGTSVTVSS

SEQ ID NO: 1247 - protein, 124 aa, Artificial Sequence
  Description of Artificial Sequence: Synthetic heavy chain variable domain
QVTLKESGPGILQPSQTLSLTCSFSGFSLSTSGMGVGWIRQPSGKGLEWLAHIWWDDVKRYNPALKSRLTISKDTSSSQVFLKIASVDTADTATYYCARIVSFDNDVVSAMDYWGQGTSVTVSS

SEQ ID NO: 1248 - protein, 117 aa, Artificial Sequence
  Description of Artificial Sequence: Synthetic heavy chain variable domain
QVQLQQSGAELAKPGASVKMSCKASGYTFTRYWIHWIKQRPGQGLEWIGYINPTTVYTEFNQNFKDKATLTADKSSTTASMQLSSLTSEDSAVYYCARGGSNFFDYWGQGTTLTVSS

SEQ ID NO: 1249 - protein, 117 aa, Artificial Sequence
  Description of Artificial Sequence: Synthetic heavy chain variable domain
EVKLEESGGGLVQPGESMKLSCAASGFTFSDAWMDWVRQSPEKGLEWVAEIRNKANNHATYYAESVKGKFTISRDDSKSRVYLQMNNLRAADTGIYYCTAYSNFAYWGQGTLVTVST

SEQ ID NO: 1250 - protein, 118 aa, Artificial Sequence
  Description of Artificial Sequence: Synthetic heavy chain variable domain
EVQLQQSGAELVRPGASVKLSCTASGFNIKDSLLHWVKQRPEKGLEWIGWIDPEDGETKYAPNFQDKATITTDSSSNTAYLQLISLTSVDTAIYYCAYGNYVRHFDYWGQGTTLTVSS

SEQ ID NO: 1251 - protein, 121 aa, Artificial Sequence
  Description of Artificial Sequence: Synthetic heavy chain variable domain
QVQLQQSGTELVRPGTSVRVSCKASGYAFGNHLIEWVKQRPGQGLEWIGVINPGTGGTHYNEKFKDKARLTADKSSNTAYMHLNSLTSDDSAVYFCARSPYDYHEGAMDYWGQGTSVTVSS

SEQ ID NO: 1252 - protein, 124 aa, Artificial Sequence
  Description of Artificial Sequence: Synthetic heavy chain variable domain
QVQLQQSGPELVKPGASVKISCKASGYAFSSSWMNWVKQRPGKGLEWIGRIYPGDGDTNYNGKFKGKATLTADKSSSTAYMQLSSLTSEDSAVYFCAMGIYNYDGSRYYSMDYWGQGTSVTVSS

SEQ ID NO: 1253 - protein, 120 aa, Artificial Sequence
  Description of Artificial Sequence: Synthetic heavy chain variable domain
QVQLQQPGAELVKPGASVKLSCKASGYTFTTYWMHWVKQRPGQGLEWIGEIDPSDSYTYYNQKFKGKATLTVDKSSSTAYMQLSSLTSEDSAVYYCARGDYGNPYAMDYWGQGSSVTVSS

SEQ ID NO: 1254 - protein, 124 aa, Artificial Sequence
  Description of Artificial Sequence: Synthetic heavy chain variable domain
QVTLKESGPGILQPSQTLSLTCSFSGFSLSTSNTGIGWIRQPSGTGLEWLAHIWWNDDKYYNPSLKSRLTISKETSNNQVFLKITNVDTADTASYFCVQIGRDYSNYAWYFDVWGAGTTVTVSS

SEQ ID NO: 1255 - protein, 124 aa, Artificial Sequence
  Description of Artificial Sequence: Synthetic heavy chain variable domain
QVTLKESGPGILQPSQTLSLTCSFSGFSLSTSGMGVGWIRQPSGEGLEWLTDIWWDDNKYYNPSLKSRLTISKDTSSNQVFLNITSVDTADTATYYCARRVNYYYDPYYAMDYWGQGTSVTVSS

SEQ ID NO: 1256 - protein, 112 aa, Artificial Sequence
  Description of Artificial Sequence: Synthetic heavy chain variable domain
QIQLVQSGPELKKPGETVKISCKASGYSFTDYSMHWVKQAPGKGLKWMGWINTETVEPTYADDFMGRFAFSLETSASTAFLQINNLENEDTATYFCARFGSYAMDYWGQGTS

SEQ ID NO: 1257 - protein, 121 aa, Artificial Sequence
  Description of Artificial Sequence: Synthetic heavy chain variable domain
QVQLQQSGAELARPGASVKLSCKASGYTFTDQYINWVKQRTGQGLEWIGEIYPGRGNTYYNEKFKGKATLTADKSSSTAYMQLSSLTSEDSAVYFCAREDGGYDDAWFAYWGQGTLVTVSA

SEQ ID NO: 1258 - protein, 120 aa, Artificial Sequence
  Description of Artificial Sequence: Synthetic heavy chain variable domain
QVTLKESGPGILQPSQTLSLTCSFSGFSLSTSGMGVGWIRQPSGKGLEWLAHIWWDDVKRYKPALKSRLTVSKDTSSNQVFLKIATVDAADTGTYYCARIVDGHPPFAYWGQGTLVTVSA

SEQ ID NO: 1259 - protein, 119 aa, Artificial Sequence
  Description of Artificial Sequence: Synthetic heavy chain variable domain
EVQLQQSGPELVKPGASVKISCKASGYSFSRFYMHWVKQSPENSLEWGEINPSTGGTISYNQKFKGKATLTVDKSSSTAYMQLKSLTSEESAVYYCTRGYGSNWYFDVWGAGTTVTVST

SEQ ID NO: 1260 - protein, 118 aa, Artificial Sequence
  Description of Artificial Sequence: Synthetic heavy chain variable domain
QIQLVQSGPELKRPGETVKISCKASGYTFTNYGMNWVKQAPGKGLKWMGWINTYTGDPTYADDFKGRFAFSLETSASTAYLQINNLKNEDTATYFCARIGGNSPSDYWGQGTSLTVSS

SEQ ID NO: 1261 - protein, 121 aa, Artificial Sequence
  Description of Artificial Sequence: Synthetic heavy chain variable domain
SDVQLQESGPGLVKPSQSLSLTCTVTGYSITSDYAWNWIRQFPGNKLEWMGYISYSGSTSYNPSLKSRISITRDTSKNQFFLQLNSVTTEDTATYYCARFYYGSSYAMDYWGQGTSVTVSS

SEQ ID NO: 1262 - protein, 117 aa, Artificial Sequence
  Description of Artificial Sequence: Synthetic heavy chain variable domain
QVQLQQSGAELAKPGASVKMSCKASGYTFTTYWMHWVKQRPGQGLEWIGYINPSSGYTEYNQKFKDKATLTADKSSSTAYMQLSSLTSEDSSVYYCARKGSNRGFAYWGQGTLVTVS

SEQ ID NO: 1263 - protein, 116 aa, Artificial Sequence
  Description of Artificial Sequence: Synthetic heavy chain variable domain
EVQLQQSGAELVKPGASVKLSCTVSGFNIKDTYIHWVKQRPEQGLEWIGRIDPANGNTKYDPKFQGKATITADTSSNTAYLQLSSLTSEDTAVYYCARPTGYFEYWGQGTTLTVSS

SEQ ID NO: 1264 - protein, 117 aa, Artificial Sequence
  Description of Artificial Sequence: Synthetic heavy chain variable domain
EVKLEESGGGLVQFGGSMKLSCAASGFTFSDAWMDWVRQSPEKGLEWVAEIRNKANNHATYYPESVKGRFTISRDDSKSRVYLQMNNLRAEDTGIYYCTGYSSFAYWGQGTLVTVSA

SEQ ID NO: 1265 - protein, 118 aa, Artificial Sequence
  Description of Artificial Sequence: Synthetic heavy chain variable domain
QIQLVQSGPELKKPGETVKISCKASGYTFTTAGMQWVQKMPGKGFKWIGWINTHSGEPKYADDFKGRFAFSLETSASTAYLQISNLKDEDTATFFCAPLWSDSSFAYWGQGTLVTVSA

SEQ ID NO: 1266 - protein, 121 aa, Artificial Sequence
  Description of Artificial Sequence: Synthetic heavy chain variable domain
QVQLQQSGADLVRPGTSVKVSCKASGYSFTNYLIEWVKQRPGQGLEWIGVINPGSGGTHYNEKFKDKAVLTADKSSTTAHMQLSSLTSDDSAVYFCARSPYDYNDGAMDYWGQGTSVTVSS

SEQ ID NO: 1267 - protein, 119 aa, Artificial Sequence
  Description of Artificial Sequence: Synthetic heavy chain variable domain
EVQLQQSGPELVKPGASVKISCKASGYSFSRFYMHWVKQSPENSLEWIGEINPSTGGTSYNQKFKGKATLTVDKSSSTAYMQLKSLTSEESAVYYCTRGYGSNCYFDVWGAGTTVTVST

SEQ ID NO: 1268 - protein, 117 aa, Artificial Sequence
  Description of Artificial Sequence: Synthetic heavy chain variable domain
QVQLQQSGPELVKPGTLVKISCKASGYTFTSYDINWVKQRPGQGLEWIGWIYPGDGNTKYSEKFKGKATLTADKSSSTAYMQLTSLTSENSAVYFCARDYDYPFAYWGQGTLVTVSA

SEQ ID NO: 1269 - protein, 121 aa, Artificial Sequence
  Description of Artificial Sequence: Synthetic heavy chain variable domain
EVQLVECGGCLVKPGGYLKLSCAASGFTFSSYAMSWVRQSPEKRLEWVAEISIGGSYTYYPDTVTGRFTISRDNAKNTLYLEMSSLRSEDTAMYYCAREGYDYDVRAMDYWGQGTSVTVSS

SEQ ID NO: 1270 - protein, 119 aa, Artificial Sequence
  Description of Artificial Sequence: Synthetic heavy chain variable domain
QVQLKESGPGLVAPSQSLSITCAVSGFSLTSFAIHWFRKPPGKGLEWLGVIWTGGTTNYNSALMSRLSISKDNSKSQVFLKMNSLQTDDTAMYYCARDDYDNNYAMDYWGQGTSVTVSS

SEQ ID NO: 1271 - protein, 117 aa, Artificial Sequence
  Description of Artificial Sequence: Synthetic heavy chain variable domain
EVQLVESGGGLVQPKGSLKLSCAVSAFTFTTYAMNWVRQAPGKGLEWVARIRNKSNNYATYYADSVKDRFTISRDDSQSMLYLQMNNLKIEDTAMYYCVFYYDYVYWGQGTLVTVSA

SEQ ID NO: 1272 - protein, 118 aa, Artificial Sequence
  Description of Artificial Sequence: Synthetic heavy chain variable domain
QIQLVQSGPELKKPGETVKISCKASGYTFTNYGMNWVKQAPGKGLKWMAWINTYTGEPTYADDFKGRFAFSLETSASTASLQIINLKNEDTATYFCARIGDSSPSDYWGQGTTLTVSS

SEQ ID NO: 1273 - protein, 118 aa, Artificial Sequence
  Description of Artificial Sequence: Synthetic heavy chain variable domain
EVKLVESGGDLVKPGGSLKLSCAASGFAFSSYDMSWVRQTPEKRLEWVATISSGGSYTYYPDSVKGRFTISRDNVRDTLYLQMSSLRSEDTALYYCARQAIGTYFDYWGQGTTLTVSS

SEQ ID NO: 1274 - protein, 120 aa, Artificial Sequence
  Description of Artificial Sequence: Synthetic heavy chain variable domain
DVQLVESGGGLVQPGGSRKLSCAASGFTFSSFGMHWVRQAPEKGLEWVAYISSGSSNIYYADTVKGRFTISRDNPKNTLFLQMTSLRSEDTAMYYCARGYYGNYDAMDYWGQGTSVTVSS

SEQ ID NO: 1275 - protein, 120 aa, Artificial Sequence
  Description of Artificial Sequence: Synthetic heavy chain variable domain
EVLLQRSGPDLVKPGASVTIPCKASGYTFTDYNMDWVKQSHGKSLEWIGNINTYNGGTIYNQKFKGKATLTVDKPSSTAYMELRSLTSEDTAVYYCARRLRYGGHYFDYWGQGTALTVSS

SEQ ID NO: 1276 - protein, 117 aa, Artificial Sequence
  Description of Artificial Sequence: Synthetic heavy chain variable domain
EVMLVESGGDLVKPGGSLKLSCAASGFTFSSYAMSWVRQTPEKRLEWVAYISGGGDHIYYPDSVRGRFTISRDNAKDTLYLQMSSLRSEDTALYDCARVRDWYFDVWGAGTTVTVSS

SEQ ID NO: 1277 - protein, 114 aa, Artificial Sequence
  Description of Artificial Sequence: Synthetic heavy chain variable domain
QVQLQQSGTELLRPGASVKISCKATGYTFSSYWMEWVKQRPGHGLEWIGEILPGSGTTQYNEKFKGKATFTADTSSNTAYMHLSSLTSEDSAVYYCARGTNSLWGQGTLVTVSA

SEQ ID NO: 1278 - protein, 124 aa, Artificial Sequence
  Description of Artificial Sequence: Synthetic heavy chain variable domain
QVTLKESGPGILQPSQTLSLTCSFSGFSLSTSGMGVGWIRQPSGKGLEWLALIWWDDVKRYNPALKSRLTISKDASSSQVFLKIASVDTADTATYYCARIASYDYDVVYAMDYWGQGTSVSVSS

SEQ ID NO: 1279 - protein, 117 aa, Artificial Sequence
  Description of Artificial Sequence: Synthetic heavy chain variable domain
EVQLVETGGGLVQPKGSLKLSCAVSAFTFTTYAMNWVRQAPGKGLEWVARIRNKSNNYATYYADSVKDRFTISRDDSQSMLYLQMNNLKIEDTAMYYCVFYYDYVYWGQGTLVTVSA

SEQ ID NO: 1280 - protein, 120 aa, Artificial Sequence
  Description of Artificial Sequence: Synthetic heavy chain variable domain
EVQLVESGGGLVQPGGSLRLSCAASGFTFSRYWMTWVRQAPGKGLEWVAEINPDSSTANYTPYLKDRFTISRDNAKNSLYLQMNSLRAEDTAVYYCARPVDGYYDAMDPWGQGTTVTVSS

SEQ ID NO: 1281 - protein, 123 aa, Artificial Sequence
  Description of Artificial Sequence: Synthetic heavy chain variable domain
QVTLKESGPALVKPTQTLTLTCTFSGFSLSTSGMGVGWIRQPPGKALEWLADIWWDDNKYANPSLKSRLTISKDTSSNQVFLTMTNVDPVDTATYYCARRANYGNPYYAQDYWGQGTTVTVSS

SEQ ID NO: 1282 - protein, 120 aa, Artificial Sequence
  Description of Artificial Sequence: Synthetic heavy chain variable domain
EVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPVDGYYDAMDYWGQGTSVTVSS

SEQ ID NO: 1283 - protein, 111 aa, Artificial Sequence
  Description of Artificial Sequence: Synthetic heavy chain variable domain
  MOD_RES (99)..(99): Any amino acid
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARXAAWGQGTTVTVS

SEQ ID NO: 1284 - protein, 120 aa, Artificial Sequence
  Description of Artificial Sequence: Synthetic heavy chain variable domain
EVQLVESGGGLVQPGGSLRLSCAASGFTFSRYWMSWVRQAPGKGLEWIGEINPDSSTINYTPSLKDRFTISRDNAKNSLYLQMSSVRAEDTAVYYCARPVDGYYDAMDPWGQGTTVTVSS

SEQ ID NO: 1285 - protein, 112 aa, Artificial Sequence
  Description of Artificial Sequence: Synthetic heavy chain variable domain
EVQLVESGGGLVQPGGSLRLSCAASGFTFSRYWMTWVRQAPGKGLEWIGEINPDSSTANYTPYLKDRFTISRDNAKNSLYLQMSSVRAEDTAVYYCARPVDGYYDAMDPWGQ

SEQ ID NO: 1286 - protein, 120 aa, Artificial Sequence
  Description of Artificial Sequence: Synthetic heavy chain variable domain
EVQLVESGGGLVQPGGSLRLSCAASGFTFSRYWMTWVRQAPGKGLEWVGEINPDSSTANYTPYLKDRFTISRDNAKNSLYLQMNSLRAEDTAVYYCARPVDGYYDAMDPWGQGTTVTVSS

SEQ ID NO: 1287 - protein, 123 aa, Artificial Sequence
  Description of Artificial Sequence: Synthetic heavy chain variable domain
QVTLKESGPALVKPTQTLTLTCTFSGFSLSTPGMGVWWIRQPPGKALEWLADIWWDDNKYTNPSLKSRLTISKDTSSNQVFLTMTNVDPVDTATYYCARRANYGNPYYAQDYWGQGTTVTVSS

SEQ ID NO: 1288 - protein, 123 aa, Artificial Sequence
  Description of Artificial Sequence: Synthetic heavy chain variable domain
QVTLKESGPALVKPTQTLTLTCTFSGFSLSTPGMGVWWIRQPPGKALEWLADIWWDDNKYTNPSLKSRLTISKDTSKNQVVLTMTNVDPVDTATYYCARRANYGNPYYAQDYWGQGTTVTVSS

SEQ ID NO: 1289 - protein, 125 aa, Artificial Sequence
  Description of Artificial Sequence: Synthetic heavy chain variable domain
QVTLKESGPALVKPTQTLTLTCTFSGFSLSTPGMGYALWWIRQPPGKALEWLADIWWDDNKYTNPSLKSRLTISKDTSKNQVVLTMTNMDPVDTATYYCARRANYGNPYYAQDYWGQGTTVTVSS

SEQ ID NO: 1290 - protein, 123 aa, Artificial Sequence
  Description of Artificial Sequence: Synthetic heavy chain variable domain
QVTLKETGPGILQPSQTLSLTCSFSGFSLSTSGMGVGWIRQPSGEGLEWLABIWWDDNKYYNPSLKSRLTISKDTSSNQVFLKITSVDTADTATYYCARRANYGNPYYAMDYWGQGTSVTVSS

SEQ ID NO: 1291 - protein, 123 aa, Artificial Sequence
  Description of Artificial Sequence: Synthetic heavy chain variable domain
QVTLKESGPALVKPTQTLTLTCTFSGFSLSTSGMRVSWIRQPPGKALEWLARIDWDDDKFYSTSLKTRLTISKDTSKNQVVLTMTNMDPVDTATYYCARRANYYYYYYAMDVWGQGTTVTVSS

SEQ ID NO: 1292 - protein, 123 aa, Artificial Sequence
  Description of Artificial Sequence: Synthetic heavy chain variable domain
QVTLKESGPALVKPTQTLTLTCTFSGFSLSTSGMGVGWIRQPPGKALEWLADIWWDDNKYYNPSLKSRLTISKDTSSNQVFLTMTNVDPVDTATYYCARRANYGNPYYAQDYWGQGTTVTVSS

SEQ ID NO: 1293 - protein, 222 aa, Artificial Sequence
  Description of Artificial Sequence: Synthetic heavy chain variable domain
EVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 1294 - protein, 119 aa, Artificial Sequence
  Description of Artificial Sequence: Synthetic heavy chain variable domain
EVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPDGNYWYFDVWGAGTTVTVSS

SEQ ID NO: 1295 - protein, 120 aa, Artificial Sequence
  Description of Artificial Sequence: Synthetic heavy chain variable domain
QVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSS

SEQ ID NO: 1296 - protein, 121 aa, Artificial Sequence
  Description of Artificial Sequence: Synthetic heavy chain variable domain
QVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSA

SEQ ID NO: 1297 - protein, 120 aa, Artificial Sequence
  Description of Artificial Sequence: Synthetic heavy chain variable domain
QVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSS

SEQ ID NO: 1298 - protein, 119 aa, Artificial Sequence; identical to SEQ ID NO: 1294
  Description of Artificial Sequence: Synthetic heavy chain variable domain

SEQ ID NO: 1299 - protein, 120 aa, Artificial Sequence; identical to SEQ ID NO: 1295
  Description of Artificial Sequence: Synthetic heavy chain variable domain

SEQ ID NO: 1300 - protein, 121 aa, Artificial Sequence; identical to SEQ ID NO: 1296
  Description of Artificial Sequence: Synthetic heavy chain variable domain

SEQ ID NO: 1301 - protein, 120 aa, Artificial Sequence; identical to SEQ ID NO: 1297
  Description of Artificial Sequence: Synthetic heavy chain variable domain

SEQ ID NO: 1302 - protein, 119 aa, Artificial Sequence; identical to SEQ ID NO: 1294
  Description of Artificial Sequence: Synthetic heavy chain variable domain

SEQ ID NO: 1303 - protein, 120 aa, Artificial Sequence; identical to SEQ ID NO: 1295
  Description of Artificial Sequence: Synthetic heavy chain variable domain

SEQ ID NO: 1304 - protein, 121 aa, Artificial Sequence; identical to SEQ ID NO: 1296
  Description of Artificial Sequence: Synthetic heavy chain variable domain

SEQ ID NO: 1305 - protein, 120 aa, Artificial Sequence; identical to SEQ ID NO: 1297
  Description of Artificial Sequence: Synthetic heavy chain variable domain

SEQ ID NO: 1306 - protein, 120 aa, Artificial Sequence; identical to SEQ ID NO: 1297
  Description of Artificial Sequence: Synthetic heavy chain variable domain

SEQ ID NO: 1307 - protein, 119 aa, Artificial Sequence
  Description of Artificial Sequence: Synthetic heavy chain variable domain
QVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVS

SEQ ID NO: 1308 - protein, 463 aa, Artificial Sequence
  Description of Artificial Sequence: Synthetic heavy chain variable domain
MEFGLRWIFLVAILKGVQCEVQLLESGGGLVQPGGSLRLSCAASGFTFSSYAMSWVRQAPGKGLEWVSAISGRGGRTYFADSVKGRFTISRDNSKNTLYLQMNSLRAEDTAVYFCAVEGYSGRYGFFDYWGQGTLVTVSSASTKGPSVFPLAPCSRSTSESTAALGCLVKDYFPEPVTVSWNSGALTSGVHTFPAVLQSSSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1309 - protein, 458 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCLTGDYWGQGTLVTVSSASTKGPSVFPLAPSSKSTSGGTAALGCLVKDYFPEPVTVSWNSGALTSGVHTFPAVLQSSSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1310 - protein, 454 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWFSYISSSGSTIYYADSVKGRFTISRDNAKNSLSLQMNSLRAEDTAVYYCLTGDYWGQGTLVTVSSASTKGPSVFPLAPCSRSTSESTAALGCLVKDYFPEPVTVSWNSGALTSGVHTFPAVLQSSSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1311 - protein, 454 aa, Artificial Sequence
  Description of Artificial Sequence: Synthetic heavy chain variable domain
MEFGLSWVFLLRGCQCQVQLVESGGGVVQPGRSLRLSCAASGFTFSSYGMHWVRQAPGKGLEWVAFIWYDGSNKYYADSVKGRFTISRDNSKNTLYLQMNSLRAEDTAVYYCYRVYFDYWGQGTLVTVSSASTKGPSVFPLAPCSRSTSESTAALGCLVKDYFPEPVTVSWNSGALTSGVHTFPAVLQSSSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1312 - protein, 458 aa, Artificial Sequence
  Description of Artificial Sequence: Synthetic heavy chain variable domain
MELGLCWIFLVAIIKGVQCQVQLVESGGGLVKPGGSLRLSCAASGFTFSDYYMSWIRQAPGKGLEWISYISGSGSTIYYADSVKGRFTISRDNAKNSLYLQMNSLRAEDTAVYHCARALGGMDVWGQGTTVTVSSASTKGPSVFPLAPCSRSTSESTAALGCLVKDYFPEPVTVSWNSGALTSGVHTFPAVLQSSSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1313 - protein, 461 aa, Artificial Sequence
  Description of Artificial Sequence: Synthetic heavy chain variable domain
MEWTWSFLFLVAAATGAHSQVQLVQSGAEVKKPGASVKVSCKASGYTFTSYGISWVRQAPGQGLEWMGWISAYNGNTNYAQKLQDRVTMTTDTSTTTAYMELRSLRSDDTAVYYCARRAYGANFFDYWGQGTLVTVSSASTKGPSVFPLAPCSRSTSESTAALGCLVKDYFPEPVTVSWNSGALTSGVHTFPAVLQSSSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1314 - protein, 454 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCLTGDYWGQGTLVTVSSASTKGPSVFPLAPCSRSTSESTAALGCLVKDYFPEPVTVSWNSGALTSGVHTFPAVLQSSSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1315 - protein, 463 aa, Artificial Sequence
  Description of Artificial Sequence: Synthetic heavy chain variable domain
MELGLCWVFLVAILEGVQCEVQLVESGGGLVQPGGSLRLSCAASGFTFSSFSMTWVRQAPGKGLEWVSYISSRSSTISYADSVKGRFTISRDNAKNSLYLQMNSLRDEDTAVYYCARDPLLAGATFFDYWGQGTLVTVSSASTKGPSVFPLAPCSRSTSESTAALGCLVKDYFPEPVTVSWNSGALTSGVHTFPAVLQSSSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1316 - protein, 458 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARRIGGMDVWGQGTTVTVSSASTKGPSVFPLAPCSRSTSESTAALGCLVKDYFPEPVTVSWNSGALTSGVHTFPAVLQSSSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1317 - protein, 455 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCLTGDYWGQGTLVTVSSASTKGPSVFPLAPCSRSTSESTAALGCLVKDYFPEPVTVSWNSGALTSGVHTFPAVLQSSSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1318 - protein, 459 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARRIGGMDVWGQGTTVTVSSASTKGPSVFPLAPCSRSTSESTAALGCLVKDYFPEPVTVSWNSGALTSGVHTFPAVLQSSSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1319 - protein, 459 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAIRIGGMDVWGQGTTVTVSSASTKGPSVFPLAPCSRSTSESTAALGCLVKDYFPEPVTVSWNSGALTSGVHTFPAVLQSSSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1320 - protein, 455 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCLTGDYWGQGTLVTVSSASTKGPSVFPLAPCSRSTSESTAALGCLVKDYFPEPVTVSWNSGALTSGVHTFPAVLQSSSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1321 - protein, 464 aa, Artificial Sequence
  Description of Artificial Sequence: Synthetic heavy chain variable domain
MELGLCWVFLVAILEGVQCEVQLVESGGGLVQPGGSLRLSCAASGFTFSSFSMTWVRQAPGKGLEWVSYISSRSSTISYADSVKGRFTISRDNAKNSLYLQMNSLRDEDTAVYYCARDPLLAGATFFDYWGQGTLVTVSSASTKGPSVFPLAPCSRSTSESTAALGCLVKDYFPEPVTVSWNSGALTSGVHTFPAVLQSSSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1322 - protein, 460 aa, Artificial Sequence
  Description of Artificial Sequence: Synthetic heavy chain variable domain
MEFGLCWVFLVAILEGVQCEVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAPGIAAAGRAYWGQGTLVTVSSASTKGPSVFPLAPCSRSTSESTAALGCLVKDYFPEPVTVSWNSGALTSGVHTFPAVLQSSSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1323 - protein, 463 aa, Artificial Sequence; identical to SEQ ID NO: 1315
  Description of Artificial Sequence: Synthetic heavy chain variable domain

SEQ ID NO: 1324 - protein, 458 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAIRIGGMDVWGQGTTVTVSSASTKGPSVFPLAPCSRSTSESTAALGCLVKDYFPEPVTVSWNSGALTSGVHTFPAVLQSSSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1325 - protein, 458 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARIGGMDVWGQGTTVTVSSASTKGPSVFPLAPCSRSTSESTAALGCLVKDYFPEPVTVSWNSGALTSGVHTFPAVLQSSSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1326 - protein, 454 aa, Artificial Sequence; identical to SEQ ID NO: 1314
  Description of Artificial Sequence: Synthetic heavy chain variable domain

SEQ ID NO: 1327 - protein, 455 aa, Artificial Sequence; identical to SEQ ID NO: 1317
  Description of Artificial Sequence: Synthetic heavy chain variable domain

SEQ ID NO: 1328 - protein, 455 aa, Artificial Sequence; identical to SEQ ID NO: 1320
  Description of Artificial Sequence: Synthetic heavy chain variable domain

SEQ ID NO: 1329 - protein, 459 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARRIGGMDVWGQGTTVTVSSASTKGPSVFPLAPCSRSTSESTAALGCLVKDYFPEPVTVSWNSGALTSGVHTFPAVLQSSSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1330 - protein, 464 aa, Artificial Sequence; identical to SEQ ID NO: 1321
  Description of Artificial Sequence: Synthetic heavy chain variable domain

SEQ ID NO: 1331 - protein, 464 aa, Artificial Sequence
  Description of Artificial Sequence: Synthetic heavy chain variable domain
MELGLCWVFLVAILEGVQCEVQLVESGGGLVQPGGSLRLSCAASGFTFSSFSMTWVRQAPGKGLEWVSYISSRSSTISYADSVKGRFTISRDNAKNSLYLQMNSLRDEDTAVYYCARDPLLAGATFFDYWGQGTLVTVSSASTKGPSVFPLAPCSRSTSESTAALGCLVKDYFPEPVTVSWNSGALTSGVHTFPAVLQSSSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1332 - protein, 467 aa, Artificial Sequence
  Description of Artificial Sequence: Synthetic heavy chain variable domain
MELGLCWVFLVAILEGVQCEVQLVESGGGLVQPGGSLRLSCAASGFTFSSFSMTWVRQAPGKGLEWVSYISSRSSTISYADSVKGRFTISRDNAKNSLYLQMNSLRDEDTAVYYCARDPLLAGATFFDYWGQGTLVTVSSASTKGPSVFPLAPSSKSTSGGTAALGCLVKDYFPEPVTVSWNSGALTSGVHTFPAVLQSSSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1333 - protein, 119 aa, Artificial Sequence
  Description of Artificial Sequence: Synthetic heavy chain variable domain
AEVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGVLSRYFDYWGQGTLVTVSS

SEQ ID NO: 1334 - protein, 120 aa, Artificial Sequence
  Description of Artificial Sequence: Synthetic heavy chain variable domain
EVQLQQFGAELVKPGASVKMSCKASGYTFTDYNMDWVRQSHGKSLEWIGNINPNSESTSYNQKFKGKATLTVDKSSSTAYMELRSLTSDDTAVYYCTRDGNRYDAWFAYWGQGTLVTVSS

SEQ ID NO: 1335 - protein, 120 aa, Artificial Sequence
  Description of Artificial Sequence: Synthetic heavy chain variable domain
EVQLVQSGAELKKPGASVKMSCKASGYTFTDYNMDWVRQAHGKGLEWIGNINPNSESTSYNQKFKGRATLTVDKSSSTAYMELRSLRSDDTAVYYCTRDGNRYDAWFAYWGQGTLVTVSS

SEQ ID NO: 1336 - protein, 120 aa, Artificial Sequence
  Description of Artificial Sequence: Synthetic heavy chain variable domain
QVQLVQSGAELKKPGASVKMSCKASGYTFTDYNMDWVRQAPGKGLEWIGNINPNSESTSYNQKFKGRATLTVDKSSSTAYMELRSLRSDDTAVYYCTRDGNRYDAWFAYWGQGTLVTVSS

SEQ ID NO: 1337 - protein, 120 aa, Artificial Sequence
  Description of Artificial Sequence: Synthetic heavy chain variable domain
QVQLVQSGAELKKPGASVKVSCKASGYTFTDYNMDWVRQAPGKGLEWIGNINPNSESTSYNQKFKGRATITVDKSTSTAYMELRSLRSDDTAVYYCTRDGNRYDAWFAYWGQGTLVTVSS

SEQ ID NO: 1338 - protein, 120 aa, Artificial Sequence
  Description of Artificial Sequence: Synthetic heavy chain variable domain
QVQLVQSGAELKKPGASVKVSCKASGYTFTDYNMDWVRQAPGKGLEWIGNINPNSESTSYNQKFKGRVTITVDKSTSTAYMELRSLRSDDTAVYYCTRDGNRYDAWFAYWGQGTLVTVSS

SEQ ID NO: 1339 - protein, 120 aa, Artificial Sequence
  Description of Artificial Sequence: Synthetic heavy chain variable domain
QVQLVQSGAELKKPGASVKVSCKASGYTFTDYNMDWVRQAPGQGLEWIGNINPNSESTSYNQKFKGRVTITVDKSTSTAYMELRSLRSDDTAVYYCTRDGNRYDAWFAYWGQGTLVTVSS

SEQ ID NO: 1340 - protein, 123 aa, Artificial Sequence
  Description of Artificial Sequence: Synthetic heavy chain variable domain
EVKLVNSGGGLVQPGNSLRLSCATSGFTFTDFYMSWVRQPPGKALEWLGFVRNRANGYTTEYSVSVKGRFIISRDNFQSTLFLQMNTLRAEDSGTYYCVRGPGDTADYTMDYWGQGTSVTVSS

SEQ ID NO: 1341 - protein, 115 aa, Artificial Sequence
  Description of Artificial Sequence: Synthetic heavy chain variable domain
QVQLVQSGDELKKPGASVKLSCKASGYTFTSYWINWIKQAPGQGLEWIGRIAPGSGTTYYNEVFKGRATLTVDKSSSTAYIELSSLRSEDSAVYFCARGDYGSYWGQGTLVTVSS

SEQ ID NO: 1342 - protein, 115 aa, Artificial Sequence
  Description of Artificial Sequence: Synthetic heavy chain variable domain
QVQLVQSGDELKKPGASVKLSCKASGYTFTSYWINWIRQAPGQGLEWIGRIAPGSGTTYYNEVFKGRATLTVDKSSSTAYIELSSLRSEDTAVYFCARGDYGSYWGQGTLVTVSS

SEQ ID NO: 1343 - protein, 115 aa, Artificial Sequence
  Description of Artificial Sequence: Synthetic heavy chain variable domain
QVQLVQSGAELKKPGASVKLSCKASGYTFTSYWINWIRQAPGQGLEWIGRIAPGSGTTYYNEVFKGRATLTVDKSTSTAYIELSSLRSEDTAVYFCARGDYGSYWGQGTLVTVSS

SEQ ID NO: 1344 - protein, 115 aa, Artificial Sequence
  Description of Artificial Sequence: Synthetic heavy chain variable domain
QVQLVQSGAELKKPGASVKVSCKASGYTFTSYWINWIRQAPGQGLEWIGRIAPGSGTTYYNEVFKGRATITVDKSTSTAYMELSSLRSEDTAVYFCARGDYGSYWGQGTLVTVSS

SEQ ID NO: 1345 - protein, 115 aa, Artificial Sequence
  Description of Artificial Sequence: Synthetic heavy chain variable domain
QVQLVQSGAELKKPGASVKVSCKASGYTFTSYWINWIRQAPGQGLEWIGRIAPGSGTTYYNEVFKGRVTITVDKSTSTAYMELSSLRSEDTAVYFCARGDYGSYWGQGTLVTVSS

SEQ ID NO: 1346 - protein, 115 aa, Artificial Sequence
  Description of Artificial Sequence: Synthetic heavy chain variable domain
QVQLQQSGDDLVKPGASVKLSCKASGYTFTSYWINWIKQRPGQGLEWIGRIAPGSGTTYYNEVFKGKATLTVDKYSSTAYIQLSSLSSEDSAVYFCARGDYGSYWGQGTLVTVSS

SEQ ID NO: 1347 - protein, 118 aa, Artificial Sequence
  Description of Artificial Sequence: Synthetic heavy chain variable domain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 1348 - protein, 448 aa, Artificial Sequence
  Description of Artificial Sequence: Synthetic heavy chain variable domain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1349 - protein, 120 aa, Artificial Sequence
  Description of Artificial Sequence: Synthetic heavy chain variable domain
EVQLVESGGGLVQPGRSLRLSCTASGFTFTDNYMSWVRQAPGKGLEWVGFIRNKANGYTTEYAASVKGRFTISRDDSKSIAYLQMNSLKTEDTAVYYCARDVGSNYFDYWGQGTLVTVSS

SEQ ID NO: 1350 - protein, 120 aa, Artificial Sequence
  Description of Artificial Sequence: Synthetic heavy chain variable domain
EVQLVESGGGLVQPGRSLRLSCTASGFTFTDNYMSWVRQAPGKGLEWVGFIRNKANGYTTEYAASVKGRFTISRDNSKSIAYLQMNSLKTEDTAVYYCARDVGSNYFDYWGQGTLVTVSS

SEQ ID NO: 1351 - protein, 120 aa, Artificial Sequence
  Description of Artificial Sequence: Synthetic heavy chain variable domain
EVQLVESGGGLVQPGRSLRLSCTASGFTFTDNYMSWVRQAPGKGLEWLGFIRNKANGYTTEYAASVKGRFTISRDNSKSIAYLQMNSLKTEDTAVYYCARDVGSNYFDYWGQGTLVTVSS

SEQ ID NO: 1352 - protein, 120 aa, Artificial Sequence
  Description of Artificial Sequence: Synthetic heavy chain variable domain
EVNLVESGGGLVQPGRSLRLSCTASGFTFTDNYMSWVRQAPGKGLEWLGFIRNKANGYTTDYAASVRGRFTISRDNSKSILYLQMNALRTEDTAVYYCARDVGSNYFDYWGQGTLVTVSS

SEQ ID NO: 1353 - protein, 450 aa, Artificial Sequence
  Description of Artificial Sequence: Synthetic heavy chain variable domain
EVQLVESGGGLVQPGRSLRLSCTASGFTFTDNYMSWVRQAPGKGLEWVGFIRNKANGYTTEYAASVKGRFTISRDNSKSIAYLQMNSLKTEDTAVYYCARDVGSNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1354 - protein, 216 aa, Artificial Sequence
  Description of Artificial Sequence: Synthetic heavy chain variable domain
QVQLVQSGGEVKKPGSSVKVSCKASGYTFTSYRMHWVRQSPGQGLEWIGYINPSTGYTEYNQKFKDKATITADESTNTAYMELSSLRSEDTAIYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 1355 - protein, 216 aa, Artificial Sequence
  Description of Artificial Sequence: Synthetic heavy chain variable domain
QVQLVQSGGEVKKPGSSVKVSCKASGYTFTSYRMEIWVRQSPGQGLEWIGYINPSTGYTEYNQKFKDKATITADESTNTAYMELSSLRSEDTAIYYCARGGGVFDYWGQGTLVTVSSASTKGPSVFPLAPSSKSTSGGTAALGCLVKDYFPEPVTVSWNSGALTSGVHTFPAVLQSGLYSLSSVVTVPSSSLGTQTYICNVNHKPSNTKVDKKVEP

SEQ ID NO: 1356 - protein, 119 aa, Artificial Sequence
  Description of Artificial Sequence: Synthetic heavy chain variable domain
KVQLQQSGAELVKPGASVKLSCKASGYTFTEYILHWVKQKSGQGLEWIGWFYPGNNNIKYNEKFKDKATLTADKSSSTVYMELSRLTSEDSAVYFCARHEQGPGYFDYWGQGTTLTVSS

SEQ ID NO: 1357 - protein, 118 aa, Artificial Sequence
  Description of Artificial Sequence: Synthetic heavy chain variable domain
KVQLQQSGAELVKPGASVKLSCKASGYTFTDYTIHWVKQRSGQGLEWIGWFYPGGGYIKYNEKFKDRATLTADKSSNTVYMELSRLTSEGSAVYFCARHEEGIYFDYWGQGTTLTVSS

SEQ ID NO: 1358 - protein, 118 aa, Artificial Sequence
  Description of Artificial Sequence: Synthetic heavy chain variable domain
KVQLQQSGAELVKPGASVKLSCKASGYTFTDYTIHWVKQRSGQGLEWIGWFYPGGGYIKYNEKFKDRATLTADKSSNTVYMELSRLTSEDSAVYFCARHEEGIYFDYWGQGTTLTVSS

SEQ ID NO: 1359 - protein, 126 aa, Artificial Sequence
  Description of Artificial Sequence: Synthetic heavy chain variable domain
QVQLVQSGAEMKKPGASVKVSCKTSGYTFTNYKINWVRQAPGQGLEWMGWMNPDTDSTGYPQKFQGRVTMTRNTSISTAYMELSSLRSEDTAVYYCARSYGSGSYYRDYYYGMDVWGQGTTVTVSS

SEQ ID NO: 1360 - protein, 120 aa, Artificial Sequence
  Description of Artificial Sequence: Synthetic heavy chain variable domain
EVKFLESGGGLVQPGGSLKLSCVASGFDFSRYWMSWVRQAPGKGLEWIGEINPDSNTINYTPSLKDKFIISRDNAKNTLYLQMTKVRSEDTALYYCTRRAYYGNPAWFAYWGQGTLVTVS

SEQ ID NO: 1361 - protein, 120 aa, Artificial Sequence
  Description of Artificial Sequence: Synthetic heavy chain variable domain
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYYYGMDVWGQGTTVTV

SEQ ID NO: 1362 - protein, 120 aa, Artificial Sequence
  Description of Artificial Sequence: Synthetic heavy chain variable domain
EVQLVQSGGGVERPGGSLRLSCAASGFTFDDYAMSWVRQAPGKGLEWVSGINWQGGSTGYADSVKGRVTISRDNAKNSLYLQMNSLRAEDTAVYYCAKILGAGRGWYFDYWGKGTTVTVS

SEQ ID NO: 1363 - protein, 119 aa, Artificial Sequence [sequence omitted]

SEQ ID NO: 1364 - protein, 119 aa, Artificial Sequence
  Description of Artificial Sequence: Synthetic heavy chain variable domain
QVQLVQSGAEVKKPGASVKVSCKASGYTFIDYYIHWVRQAPGQGLEWMGWINPKSGGTKYAQKFQGRVTMTRDTSITTAYMELSSLTSDDTAVYYCARSYYYGGVKDYWGQGTLVTVSS

SEQ ID NO: 1365 - protein, 122 aa, Artificial Sequence
  Description of Artificial Sequence: Synthetic heavy chain variable domain
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSS

SEQ ID NO: 1366 - protein, 119 aa, Artificial Sequence
  Description of Artificial Sequence: Synthetic heavy chain variable domain
EVQLVQSGAEVKKPGSSVKVSCKASGGTFSMAAISWVRQAPGQGLEWMGRIIPMIGIPDYAQEFQGRVTFTADRSTSTAYMELSSLRSDDTAVYYCARGPLYWWHSDSWGQGTLVTVSS

SEQ ID NO: 1367 - protein, 120 aa, Artificial Sequence
  Description of Artificial Sequence: Synthetic heavy chain variable domain
QVQLVQSGGGVVQPGRSLRLSCAASGFTFSSYAIHWVRQAPGKGLEWVAVISYDGTNKYYADSVKGRFTISRDNSKNTLYLQMNSLRAEDTAVYYCARMHGSYGSYFDKWGQGTLVTVSS

SEQ ID NO: 1368 - protein, 119 aa, Artificial Sequence
  Description of Artificial Sequence: Synthetic heavy chain variable domain
QVQLVQSGAEVKKPGSSVKVSCKASGGTFRSYAVSWVRQAPGQGLEWMGRIIPIFGTPDYAQKFQGRVTITADASTSTAHMELSGLRSEDTAVYYCARSSMYQYSHDDWGQGTLVTVSS

SEQ ID NO: 1369 - protein, 121 aa, Artificial Sequence
  Description of Artificial Sequence: Synthetic heavy chain variable domain
EVQLVQSGAEVKKPGASVKVSCKASGYTFANYGINWVRQAPGQGLEWMGWISASNGNTNYAQKLQGRVTMTTDTSTSTAYMELRSLRSDDTAVYYCARSYYAGYYMFMDFWGQGTLVTVSS

SEQ ID NO: 1370 - protein, 118 aa, Artificial Sequence
  Description of Artificial Sequence: Synthetic heavy chain variable domain
EVQLVESGGGLVQPGGSLRLSCAASGFTFSSYWMSWVRQAPGKGLEWVANINQDGSEKYYVDSVKGRFTISRDNAKNSLYLQMNSLRAEDTAVYYCARYSVWGMMDEWGQGTLVTVSS

SEQ ID NO: 1371 - protein, 118 aa, Artificial Sequence
  Description of Artificial Sequence: Synthetic heavy chain variable domain
QVQLVQSGGGVVQPGRSQRLSCAASGFPFSSYSMNWVRRAPGKGLEWVSYISSSSSTIYYADSVKGRFTISRDNAKNSLYLQMNSLRAEDTAVYYCARQNYYADYDYWGQGTLVTVSS

SEQ ID NO: 1372 - protein, 121 aa, Artificial Sequence
  Description of Artificial Sequence: Synthetic heavy chain variable domain
QVQLVQSGAEVKKPGASVKVSCKTSGYTFSDYGISWVRQAPGQGLEWLGWISTYNGNTDLAQKVRGRVTLTTDTSTSTAYMELRSLRSEDTAVYYCARGYTGSYYATGDEWGQGTLVTVSS

SEQ ID NO: 1373 - protein, 118 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYRGDVWGQGTLVTVSS

SEQ ID NO: 1374 - protein, 118 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCLRAPQSWYVGDVWGQGTLVTVSS

SEQ ID NO: 1375 - protein, 118 aa, Artificial Sequence
  Description of Artificial Sequence: Synthetic heavy chain variable domain
QVQLQQWGAGLLKPSETMSLTCAVYGGSFSGYYWSWIRQPPGKGLEWIGEINHSGSTNYNPSLKSRVTISVDTSKNQFSLKLSSVTAADTAVYYCARAPQSWYRGDVWGQGTLVTVSS

SEQ ID NO: 1376 - protein, 118 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTMSVDTSKRQFSLKLSSVTAADTAVYYCARAPQSWYVGDVWGQGTLVTVSS

SEQ ID NO: 1377 - protein, 118 aa, Artificial Sequence
  Description of Artificial Sequence: Synthetic heavy chain variable domain
QVQLQQWGAGLLKPSETLSLTCAVYGGSFSGYYWSWIRQLPGKGLEWIGEINHSGSTNYNPYLKSRVTISVDTSKRQFSLKLSSVTAADTAVYYCARAPQSWYVGDVWGQGTLVTVSS

SEQ ID NO: 1378 - protein, 114 aa, Artificial Sequence
  Description of Artificial Sequence: Synthetic heavy chain variable domain
QVQLVQSGAEVKKPGASVKVSCKASGYTFTSYGISWVRQAPGQGLEWMGWISPYNGNTNYAQKLQGRVTMTTDTSTSTAYMELRSLRSDDTAVYYCARGYKDYWGQGTLVTVSS

SEQ ID NO: 1379 - protein, 120 aa, Artificial Sequence
  Description of Artificial Sequence: Synthetic heavy chain variable domain
QVQLVQSGAEVRKPGSSVKVSCKASGDIFRKFAVSWVRQAPGQGPEWMGRIIPNLDITDKPQKFQGRVTLSADKSTSTVYLELSSLRSEDTAVYYCARGSIYQWSGWDSWGQGTLVTVSS

SEQ ID NO: 1380 - protein, 118 aa, Artificial Sequence
  Description of Artificial Sequence: Synthetic heavy chain variable domain
EVQLVESGGGLVKPGGSLRLSCAASGFNFSDYYMTWIRQAPGKGLEWLSYISPGGTTYYAASVEGRFTISRDNAKNSLYLQMNSLRAEDTAVYYCARGHSFSYGEDYWGQGTLVTVSS

SEQ ID NO: 1381 - protein, 119 aa, Artificial Sequence
  Description of Artificial Sequence: Synthetic heavy chain variable domain
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGWHQYGIMDYWGQGTLVTVSS

SEQ ID NO: 1382 - protein, 118 aa, Artificial Sequence
  Description of Artificial Sequence: Synthetic heavy chain variable domain
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARRSVWSAYDSWGQGTLVTVSS

SEQ ID NO: 1383 - protein, 118 aa, Artificial Sequence
  Description of Artificial Sequence: Synthetic heavy chain variable domain
QVQLVQSGGGLVQPGGSLRLSCAASGFTFSSYWMSWVRQAPGKGLEWVGNIKEDGSVKYYVDSVKGRFTISRDNAKNSVYLEMNNLRAEDTAVYYCARRGVWGHIDFWGQGTLVTVSS

SEQ ID NO: 1384 - protein, 118 aa, Artificial Sequence
  Description of Artificial Sequence: Synthetic heavy chain variable domain
EVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGTYTWGSDTWGQGTLVTVSS

SEQ ID NO: 1385 - protein, 116 aa, Artificial Sequence
  Description of Artificial Sequence: Synthetic heavy chain variable domain
QVQLVESGGGLVQPGGSLRLSCAASGFSFSRHAMNWVRQAPGKGLEWVSAISGSGGNTYYSDSVEGRFTMSRDNSKNTLYLQMNSLRAEDTAVYYCARYWGSYDKWGQGTLVTVSS

SEQ ID NO: 1386 - protein, 120 aa, Artificial Sequence
  Description of Artificial Sequence: Synthetic heavy chain variable domain
EVQLVQSGAEVKKPGASVKVSCTASGYSFSDYYIYWLRQGPGQGLEWMGWINPNTGVTHYAQKYQGRVTMTRDTSINTVYMELSRLRSDDTAVYYCARNVYRYSMMHDSWGQGTLVTVSS

SEQ ID NO: 1387 - protein, 118 aa, Artificial Sequence
  Description of Artificial Sequence: Synthetic heavy chain variable domain
QAQLVQSGGGLVKPGGSLRLSCAASGFTFSSYSMNWVRQAPGKGLEWVSSISSSSSYIYYADSVRGRFTISRDNAKNSLFLQMNSLRAEDTAVYYCARRGVWGYFDSWGQGTLVTVSS

SEQ ID NO: 1388 - protein, 118 aa, Artificial Sequence
  Description of Artificial Sequence: Synthetic heavy chain variable domain
EVQLVQSGAEVKKPGSSVKVSCKASGGTFSSYGISWVRQAPGQGLEWMGGIIPIFGTTNYAQKFQGRVTITADESTRTAYMELSSLRSEDTAVYYCARVYGSYFYDDWGQGTLVTVSS

SEQ ID NO: 1389 - protein, 118 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 1390 - protein, 112 aa, Artificial Sequence
  Description of Artificial Sequence: Synthetic heavy chain variable domain
EVQLVESGGGLVQPGGSLRLSCAASGFTVTTYGVDWVRQAPGKGLEWLGVIWGGGSTNYNSALKSRFTISRDNSKNTLYLQMNSLRAEDTAVYYCASDWAYWGQGTLVTVSS

SEQ ID NO: 1391 - protein, 122 aa, Artificial Sequence
  Description of Artificial Sequence: Synthetic heavy chain variable domain
EVQLVESGGGLVKPGGSLRLSCAASGFTFSTYGMSWVRQAPGKGLEWVATISSGGTYTYYPDSVKGRFKISRDNAKNSLYLQMNSLRAEDTAVYYCTRHDPNDGYYFLFAYWGQGTLVTVSS

SEQ ID NO: 1392 - protein, 120 aa, Artificial Sequence
  Description of Artificial Sequence: Synthetic heavy chain variable domain
QVQLVQSGAEVKKPGASVKVSCKASGYTFTGYYIHWVRQAPGQGLEWMGWIYPGNFNTKYNERFKGRVTMTTDTSTSTAYMELRSLRSDDTAVYYCAREDGSPYYAMDYWGQGTSVTVSS

SEQ ID NO: 1393 - protein, 118 aa, Artificial Sequence
  Description of Artificial Sequence: Synthetic heavy chain variable domain
QVQLVQSGAEVKKPGASVKVSCKASGYTFTYFYMNWVRQAPGQGLEWVGQINPNNGGTAYAQKFQGRVTMTRDTSTSTVYMELSSLRSEDTAVYYCARWVGTHYFDYWGQGTTLTVSS

SEQ ID NO: 1394 - protein, 120 aa, Artificial Sequence; identical to SEQ ID NO: 1392
  Description of Artificial Sequence: Synthetic heavy chain variable domain

SEQ ID NO: 1395 - protein, 118 aa, Artificial Sequence; identical to SEQ ID NO: 1393
  Description of Artificial Sequence: Synthetic heavy chain variable domain

SEQ ID NO: 1396 - protein, 445 aa, Artificial Sequence
  Description of Artificial Sequence: Synthetic heavy chain variable domain
QVQLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1397 - protein, 116 aa, Artificial Sequence
  Description of Artificial Sequence: Synthetic heavy chain variable domain
EVQLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSS

SEQ ID NO: 1398 - protein, 116 aa, Artificial Sequence
  Description of Artificial Sequence: Synthetic heavy chain variable domain
EVQLQESGPGLVKPSQTLSLTCTVSGYSISRDFAWNWIRQPPGKGLEWMGYISYNGNTRYQPSLKSRITISRDTSKNQFFLKLNSVTAADTATYYCVTASRGFPYWGQGTLVTVSS

SEQ ID NO: 1399 - protein, 105 aa, Artificial Sequence
  Description of Artificial Sequence: Synthetic heavy chain variable domain
QSVLTQDPAVSGQTVKITCQGDSLRSYFASWYQQKPGQAPTLVMYARNDRPAGVPDRFSGSKSGTSASLAISGLQSEDEADYYCAAWDDSLNGYLFGAGTKLTVL

SEQ ID NO: 1400 - protein, 105 aa, Artificial Sequence
  Description of Artificial Sequence: Synthetic heavy chain variable domain
QSVLTQDPAVSGQTVKITCQGDSLRSYFASWYQQKPGQAPTLVMYARNDRPAGVPDRFSGSKSGTSASLAISGLQPEDEADYYCAAWDDSLNGYLFGAGTKLTVL

SEQ ID NO: 1401 - protein, 105 aa, Artificial Sequence
  Description of Artificial Sequence: Synthetic heavy chain variable domain
QSVLTQDPAASGQTVKITCQGDSLRSYFASWYQQKPGQAPTLVMYARNDRPAGVPDRFSGSKSGTSASLAISGLQSEDEADYYCAAWDDSLNGYLFGAGTKLTVL

SEQ ID NO: 1402 - protein, 105 aa, Artificial Sequence
  Description of Artificial Sequence: Synthetic heavy chain variable domain
QSVLTQDPAVSGQTVKITCQGDSLRSYLASWYQQKPGQAPTLVTYARNDRPAGVPDRFSGSKSGTSASLAISGLQSEDEADYYCAAWDDSLNGYLFGAGTKLTVL

SEQ ID NO: 1403 - DNA, 443 bp, Artificial Sequence
  Description of Artificial Sequence: Synthetic heavy chain variable domain
aagcttgccaccatgggctggtcatgtatcattctgttcctggtggccaccgcaaccggtgtccattcccaggtgcagctcgtgcagagcggggctgaagtggccaagccaggtgcttctgtcaaattgtcttgtaaggccagtgggtacaccttcacaagctactggatgcagtgggttaagcaacgcccaggccagggactggagtggatcggcaccatttatccaggggatggagataccacttatacacaaaagtttcaaggcaaagccaccctgaccgccgacaaatccagcagcacagcatacatgcagctttctagcctcaggtctgaagactccgccgtgtactattgtgcccgctacgacgcccccggctatgcaatggattactggggccagggtactctggtcacagtgtcctccgcctctacaaagggccc

SEQ ID NO: 1404 - DNA, 443 bp, Artificial Sequence
  Description of Artificial Sequence: Synthetic heavy chain variable domain
aagcttgccaccatggggtggagttgtatcatcctcttccttgtcgctaccgccactggagtgcattcccaggtgcagttggtgcaatctggcgccgaggtggccaagcccggtgcctccgtaaaattgagttgtaaagcctctggctatacatttacatcttattggatgcagtgggtcaagcagcgccctggtcaaggcctggagtggatcggagctctgtatcctggcgacggggacgcccgttacactcagaaatttcagggcaaagctaccctcaccgcagatacatccagcagcactgcttatatgcaacttagtagcctccgcagcgaggatagtgccgtgtactactgtgccagatatgacgccccaggttatgctatggactactggggtcaaggaaccctggtgacagtgtcaagcgctagcacaaagggccc

SEQ ID NO: 1405 - protein, 119 aa, Artificial Sequence
  Description of Artificial Sequence: Synthetic heavy chain variable domain
QVQLQQSGTELARPGASVKLSCKASGYTFTSYWMQWVKQRPGQGLECIGTIYPGDGDTRYIQKFKGKATLTADKSSSTAYMQLSSLASEDSAVYYCARYDAPGYAMDYWGQGTSVTVSS

SEQ ID NO: 1406 - protein, 119 aa, Artificial Sequence
  Description of Artificial Sequence: Synthetic heavy chain variable domain
QVQLQQSGAELARPGASVKLSCKASGYTFTSYWMQWVKQRPGQGLECIGALYPGDGDARYTQKFKGKATLTADRSSSTAYMQLSSLASEDSAVYYCARYDAPGYAMDYWGQGTSVTVAS

SEQ ID NO: 1407 - protein, 119 aa, Artificial Sequence
  Description of Artificial Sequence: Synthetic heavy chain variable domain
QVQLQQSGAELARPGASVKLSCKASGYTFTSYWMQWVKQRPGQGLECIGTIYPGDGDTTYTQKFKGKATLTADKSSSTAYMQLSSLASEDSAVYYCARYDAPGYAMDYWGQGTSVTVSS

SEQ ID NO: 1408 - protein, 119 aa, Artificial Sequence
  Description of Artificial Sequence: Synthetic heavy chain variable domain
QVQLVQSGAEVAKPGASVKLSCKASGYTFTSYWMQWVKQRPGQGLECIGALYPGDGDARYTQKFQGKATLTADTSSSTAYMQLSSLRSEDSAVYYCARYDAPGYAMDYWGQGTLVTVSS

SEQ ID NO: 1409 - protein, 119 aa, Artificial Sequence
  Description of Artificial Sequence: Synthetic heavy chain variable domain
QVQLVQSGAEVAKPGASVKLSCKASGYTFTSYWMQWVKQRPGQGLECIGTIYPGDGDTRYIQKFQGKATLTADKSSSTAYMQLSSLRSEDSAVYYCARYDAPGYAMDYWGQGTLVTVSS

SEQ ID NO: 1410 - protein, 119 aa, Artificial Sequence
  Description of Artificial Sequence: Synthetic heavy chain variable domain
QVQLVQSGAEVAKPGASVKLSCKASGYTFTSYWMQWVKQRPGQGLEWIGALYPGDGDARYTQKFQGKATLTADTSSSTAYMQLSSLRSEDSAVYYCARYDAPGYAMDYWGQGTLVTVSS

SEQ ID NO: 1411 - protein, 119 aa, Artificial Sequence
  Description of Artificial Sequence: Synthetic heavy chain variable domain
QVQLVQSGAEVAKPGASVKLSCKASGYTFTSYWMQWVKQRPGQGLEWIGTIYPGDGDTTYTQKFQGKATLTADKSSSTAYMQLSSLRSEDSAVYYCARYDAPGYAMDYWGQGTLVTVSS

SEQ ID NO: 1412 - protein, 119 aa, Artificial Sequence
  Description of Artificial Sequence: Synthetic heavy chain variable domain
QVQLVQSGAEVKKPGASVKVSCKASGYTFTSYWMQWVRQAPGQGLEWMGTIYPGDGDTTYTQKFKGRVTMTRDTSTSTVYMELSSLRSEDTAVYYCARYDAPGYAMDYWGQGTLVTVSS

SEQ ID NO: 1413 - protein, 119 aa, Artificial Sequence
  Description of Artificial Sequence: Synthetic heavy chain variable domain
QVQLQQSGPGLVKPSETLSLTCTVSGFSISNYGVHWIRQPPGKGLEWIGVIWSGGNTDYNTPFTSRVTINKDNSKSQVSFKMSSVTAADTAVYYCARALTYYDYEFAYWGQGTLVTVSA

SEQ ID NO: 1414 - protein, 119 aa, Artificial Sequence
  Description of Artificial Sequence: Synthetic heavy chain variable domain
QVQLQQSGPGLVKPSETLSLTCTVSGFSISNYGVHWIRQSPGKGLEWIGVIWSGGNTDYNTPFTSRVTINKDNSKSQFSLKLSSVTAADTAVYYCARALTYYDYEFAYWGQGTLVTVSA

SEQ ID NO: 1415 - protein, 119 aa, Artificial Sequence
  Description of Artificial Sequence: Synthetic heavy chain variable domain
QVQLQQSGPGLVKPSETLSLTCTVSGFSISNYGVHWIRQSPGKGLEWIGVIWSGGNTDYNTPFTSRVTINKDNSKSQVSFKMSSVTAADTAVYYCARALTYYDYEFAYWGQGTLVTVSA

SEQ ID NO: 1416 - protein, 119 aa, Artificial Sequence
  Description of Artificial Sequence: Synthetic heavy chain variable domain
QVQLQESGPGLVKPSETLSLTCTVSGFSISNYGVHWIRQSPGKGLEWIGVIWSGGNTDYNTPFTSRVTISVDTSKNQFSLKLSSVTAADTAVYYCARALTYYDYEFAYWGQGTLVTVSA

SEQ ID NO: 1417 - protein, 119 aa, Artificial Sequence
  Description of Artificial Sequence: Synthetic heavy chain variable domain
QVQLQESGPGLVKPSETLSLTCTVSGFSISNYGVHWIRQPPGKGLEWIGVIWSGGNTDYNTPFTSRVTISKDTSKNQVSLKLSSVTAADTAVYYCARALTYYDYEFAYWGQGTLVTVSA

SEQ ID NO: 1418 - protein, 119 aa, Artificial Sequence
  Description of Artificial Sequence: Synthetic heavy chain variable domain
QVQLQESGPGLVKPSETLSLTCTVSGGSISNYGVHWIRQPPGKGLEWIGVIWSGGNTDYNTPFTSRVTINKDNSKSQVSFKMSSVTAADTAVYYCARALTYYDYEFAYWGQGTLVTVSA

SEQ ID NO: 1419 - protein, 119 aa, Artificial Sequence
  Description of Artificial Sequence: Synthetic heavy chain variable domain
QVQLQESGPGLVKPSETLSLTCTVSGGSISNYGVHWIRQPPGKGLEWIGVIWSGGNTDYNTPFTSRVTISVDTSKNQFSLKLSSVTAADTAVYYCARALTYYDYEFAYWGQGTLVTVSA

SEQ ID NO: 1420 - protein, 119 aa, Artificial Sequence
  Description of Artificial Sequence: Synthetic heavy chain variable domain
  MOD_RES (6)..(6): Any amino acid
  MOD_RES (27)..(27): Any amino acid
  MOD_RES (40)..(40): Any amino acid
  MOD_RES (70)..(71): Any amino acid
  MOD_RES (73)..(73): Any amino acid
  MOD_RES (76)..(76): Any amino acid
  MOD_RES (78)..(78): Any amino acid
  MOD_RES (80)..(80): Any amino acid
  MOD_RES (82)..(82): Any amino acid
  MOD_RES (88)..(88): Any amino acid
QVQLQXSGPGLVKPSETLSLTCTVSGXSISNYGVHWIRQXPGKGLEWIGVIWSGGNTDYNTPFTSRVTIXXDXSKXQXSXKXSSVTAXDTAVYYCARALTYYDYEFAYWGQGTLVTVSA

SEQ ID NO: 1421 - protein, 122 aa, Artificial Sequence
  Description of Artificial Sequence: Synthetic heavy chain variable domain
EVQLVESGGGVVQPGGSLRLSCAASGFTFSDYDMSWIRQAPGKGLEWVSGILGGSERSYYRDSVKGRFTISRDNSRKTLYLQMNSLRAEDTAVYYCARHGSPGYTLYAWDYWGQGTTVTVSS

SEQ ID NO: 1422 - protein, 621 aa, Artificial Sequence
  Description of Artificial Sequence: Synthetic heavy chain variable domain
LEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPKDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPS

SEQ ID NO: 1423 - protein, 118 aa, Artificial Sequence
  Description of Artificial Sequence: Synthetic heavy chain variable domain
QVQLVQSGAEVKKPGASVKVSCKASGYTFTSHWMHWVRQAPGQGLEWMGWINPSSGRNNYAQKFQGRVTMTRDTSISTAYMELSRLTSDDTAVYYCARYYGYDEAMDYWGQGTSVTVS

SEQ ID NO: 1424 - protein, 122 aa, Artificial Sequence
  Description of Artificial Sequence: Synthetic heavy chain variable domain
QVQLVQSGAEVKKPGASVKVSCKASGYTFTSYWMHWVRQAPGQGLEWMGIIYPGSRSTSYAQKFQGRVTMTRDTSTSTVYMELSSLRSEDTAVYYCTRNGDYYVSSGDAMDYWGQGTLVTVS

SEQ ID NO: 1425 - protein, 124 aa, Artificial Sequence
  Description of Artificial Sequence: Synthetic heavy chain variable domain
RAEVQLQQPGSELVRPGASVKLSCKASGYTFTSYWMHWVKQRPGQGLEWIGNIYPGSRSTNYDEKFKSKATLTVDTSSSTAYMQLSSLTSEDSAVYYCTRNGDYYVSSGDAMDYWGQGTSVTVS

SEQ ID NO: 1426 - protein, 249 aa, Artificial Sequence
  Description of Artificial Sequence: Synthetic heavy chain variable domain
RAEVQLQQPGSELVRPGASVKLSCKASGYTFTSYWMHWVKQRPGQGLEWIGNIYPGSRSTNYDEKFKSKATLTVDTSSSTAYMQLSSLTSEDSAVYYCTRNGDYYVSSGDAMDYWGQGTSVTVSSASTKGPQVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVS

SEQ ID NO: 1427 - protein, 125 aa, Artificial Sequence
  Description of Artificial Sequence: Synthetic heavy chain variable domain
RAEVQLQQSGAELVRPGSSVKISCKASGYAFSSYWMNWVRQRPGQGLEWIGQIYPGDGDTNYNGKFKGRATLTANKSSSTAYMQLSSLTSEDSAVYFCARRASSLYDVYPYYFDYWGQGTTLTVS

SEQ ID NO: 1428 - protein, 125 aa, Artificial Sequence
  Description of Artificial Sequence: Synthetic heavy chain variable domain
RAEVQLQQSGPELVKPGASVKIPCKTSGYTFTDYNMAWVKQSHGKSLEWIGDIIPNNGGAIYNQKFKGKATLTVDKSSSTASMELRSLTSEDTAVYFCARKNIYYRYDGAGALDYWGQGTSVTVS

SEQ ID NO: 1429 - protein, 118 aa, Artificial Sequence
  Description of Artificial Sequence: Synthetic heavy chain variable domain
RAEVQLVESGGGLVKPGESLKLSCAASGFAFSYSDMSWVRQTPEKRLEWVAYMSSAGDVTFYSDTVKGRFTISRDNAKNTLYLQVSSLKSEDTAIYYCVRHRDVAMDYWGQGTSVTVS

SEQ ID NO: 1430 - protein, 122 aa, Artificial Sequence
  Description of Artificial Sequence: Synthetic heavy chain variable domain
RAEVQLVESGGGLVKPGGSLKLSCAASGFAFSSYDMSWVRQTPEKRLEWVAYIGSGDDNTHYPDSVKGRFTISRHNAKNTLYLQMSSLKSEDTAMYYCARQKYGNYGDTMDYWGQGTSVTVS

SEQ ID NO: 1431 - protein, 122 aa, Artificial Sequence
  Description of Artificial Sequence: Synthetic heavy chain variable domain
RAEVQLVESGGGLVKPGGSLKLSCAASGFAYSTYDMSWVRQTPEKRLEWVAYISSGGDAAYYPDTVKGRFTISRDNAKNTLYLQMSSLKSEDTAMYYCARSRYGNYGDAMDYWGQGTSVTVS

SEQ ID NO: 1432 - protein, 120 aa, Artificial Sequence
  Description of Artificial Sequence: Synthetic heavy chain variable domain
RAEVQLVESGGGLVKPGGSLKLSCAASGFTFSSYALSWVRQTPERRLEWVASISGVGSTYFPDSVKGRFTMSRDNARNILYLQMSSLRSEDTAMYYCARGSDGYFYAMDYWGQGTSVTVS

SEQ ID NO: 1433 - protein, 124 aa, Artificial Sequence
  Description of Artificial Sequence: Synthetic heavy chain variable domain
RAEVQLVESGGGLVKPGGSLKLSCAVSGFTFSSYVMSWVRQTPEKRLEWVATITSGGRNIYYLDSVKGRFTISRDNAKNTLYLQMSSLRSEDTAMYYCARHEDYRYDGYYAMDYWGQGTSVTVS

SEQ ID NO: 1434 - protein, 122 aa, Artificial Sequence
  Description of Artificial Sequence: Synthetic heavy chain variable domain
RAQVQLKESGPGLVAPSQSLSITCSVSGFSLTIYGVHWVRQPPGKGLEWLGVMWAGGNTDYNSALMSRLNISKDNSKSQVFLKVNSLQTDDTAMYYCTRDPDGYYVGWFFDVWGAGTTVTVS

SEQ ID NO: 1435 - protein, 119 aa, Artificial Sequence
  Description of Artificial Sequence: Synthetic heavy chain variable domain
RAQVQLKESGPGLVAPSQSLSITCTVSGFSLTGHGVNWVRQPPGKGLEWLGMIWGDGSTDYNSTLKSRLSISKDNSKSQVFLKMNSLQTDDTARYYCARGYGYLYYFDYWGQGTTLTVS

SEQ ID NO: 1436 - protein, 117 aa, Artificial Sequence
  Description of Artificial Sequence: Synthetic heavy chain variable domain
RAQVQLKESGPGLVAPSQSLSITCTVSGFSLTIYGVHWVRQPPGKGLEWLGVIWAGGNTNYNSALMSRLSISKDNSKSQVFLKMNSLQTDDTAMYFCARGYGYNLDYWGQGTTLTVS

SEQ ID NO: 1437 - protein, 117 aa, Artificial Sequence
  Description of Artificial Sequence: Synthetic heavy chain variable domain
RAQVQLKESGPGLVAPSQSLSITCTVSGFSLTTYGVHWVRQPPGKGLEWLGVIWAGGSTNYNSALMSRLSIKKDNSKSQVFLKMNSLQTDDTAMYYCARAYGYNFDYWGQGTTLTVS

SEQ ID NO: 1438 - protein, 120 aa, Artificial Sequence
  Description of Artificial Sequence: Synthetic heavy chain variable domain
RAQVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVS

SEQ ID NO: 1439 - protein, 249 aa, Artificial Sequence
  Description of Artificial Sequence: Synthetic heavy chain variable domain
RAQVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVSSASTKGPEVQLQQPGSELVRPGASVKLSCKASGYTFTSYWMHWVKQRPGQGLEWIGNIYPGSRSTNYDEKFKSKATLTVDTSSSTAYMQLSSLTSEDSAVYYCTRNGDYYVSSGDAMDYWGQGTSVTVS

SEQ ID NO: 1440 - protein, 121 aa, Artificial Sequence
  Description of Artificial Sequence: Synthetic heavy chain variable domain
RAQVQLQQPGAELVKPGASMKLSCKASGYTFTNYWMHWVKQRPGQGLEWIGEINPSNGRTNYNEKFKSKATLTVDKSSSTAYMQLSSLTSEDSGVYYCAKGGNYYDYDWDYWGQGTTLTVS

SEQ ID NO: 1441 - protein, 119 aa, Artificial Sequence
  Description of Artificial Sequence: Synthetic heavy chain variable domain
RAQVQLQQPGAELVKPGASVKLSCKASGYTFTSDWMHWMKQRPGQGLEWIGEINPSNGRSSYNEKFKSKATLTVDKSSSTAYMQLSSLTSEDSAVYYCARIGGIYVETYWGQGTLVTVS

SEQ ID NO: 1442 - protein, 120 aa, Artificial Sequence
  Description of Artificial Sequence: Synthetic heavy chain variable domain
RAQVQLQQPGAELVKPGASVKLSCKASGYTFTSHWMHWVQQRPGQGLEWIGEIHPSNGRTNYNEKFKNKATLTVDKSPSTAYMQLSSLTSEDSAVYYCARYYGYDDAMDYWGQGTSVTVS

SEQ ID NO: 1443 - protein, 117 aa, Artificial Sequence
  Description of Artificial Sequence: Synthetic heavy chain variable domain
DVQLQESGPGLVKPSQSLSLTCTVTGYSITSDYAWNWIRLFPGNKLEWMGFINYSGNTSYNPSLKSRISITRDTSKNQFFLKLNSLTTDDTATYYCARGGLSRFPYWGQGTLVTVSA

SEQ ID NO: 1444 - protein, 119 aa, Artificial Sequence
  Description of Artificial Sequence: Synthetic heavy chain variable domain
EVQLVESGGGLVQPGGSLRLSCAVSGFSLTNYGVHWVRQATGKGLEWLGVIWSGGNTDYNTPFTSRLTISKENAKNSLYLQMNSLRAGDTAVYYCARALTYYDYEFAYWGQGTMVTVSS

SEQ ID NO: 1445 - protein, 119 aa, Artificial Sequence
  Description of Artificial Sequence: Synthetic heavy chain variable domain
EVQLVQSGAEVKKPGATVKISCKVSGFSLFNYGVHWIRQPPGKGLEWIGVIWSGGNTDYNTPFTSRFTISRDDSKNTAYLQMNSLKTEDTAVYYCARALTYYDEEFAYWGPGTLVTVSA

SEQ ID NO: 1446 - protein, 119 aa, Artificial Sequence
  Description of Artificial Sequence: Synthetic heavy chain variable domain
EVQLVQSGAEVKKPGATVKISCKVSGFSLFNYGVHWIRQPPGKGLEWIGVIWSGGNTDYNTPFTSRFTISRDDSKNTAYLQMNSLKTEDTAVYYCARALTYYDEEFAYWGPGTLVTVSS

SEQ ID NO: 1447 - protein, 119 aa, Artificial Sequence
  Description of Artificial Sequence: Synthetic heavy chain variable domain
EVQLVQSGAEVKKPGATVKISCKVSGFSLFNYGVHWIRQPPGKGLEWIGVIWSGGNTDYNTPFTSRFTISRDNSKNTLYLQMNSLRAEDTAVYYCARALTYYDEEFAYWGPGTLVTVSA

SEQ ID NO: 1448 - protein, 119 aa, Artificial Sequence
  Description of Artificial Sequence: Synthetic heavy chain variable domain
EVQLVQSGAEVKKPGATVKISCKVSGFSLFNYGVHWIRQPPGKGLEWIGVIWSGGNTDYNTPFTSRFTISRDNSKNTLYLQMNSLRAEDTAVYYCARALTYYDEEFAYWGPGTLVTVSS

SEQ ID NO: 1449 - protein, 119 aa, Artificial Sequence
  Description of Artificial Sequence: Synthetic heavy chain variable domain
EVQLVQSGAEVKKPGATVKISCKVSGFSLFNYGVHWIRQSPSRGLEWLGVIWSGGNTDYNTPFTSRFTISRDNSKNTLYLQMNSLRAEDTAVYYCARALTYYDEEFAYWGPGTLVTVSA

SEQ ID NO: 1450 - protein, 119 aa, Artificial Sequence
  Description of Artificial Sequence: Synthetic heavy chain variable domain
EVQLVQSGAEVKKPGATVKISCKVSGFSLFNYGVHWIRQSPSRGLEWLGVIWSGGNTDYNTPFTSRFTISRDNSKNTLYLQMNSLRAEDTAVYYCARALTYYDEEFAYWGPGTLVTVSS

SEQ ID NO: 1451 - protein, 119 aa, Artificial Sequence
  Description of Artificial Sequence: Synthetic heavy chain variable domain
EVQLVQSGAEVKKPGATVKISCKVSGFSLFNYGVHWVRQARGQRLEWIGVIWSGGNTDYNTPFTSRFTISRDDSKNTAYLQMNSLKTEDTAVYYCARALTYYDEEFAYWGPGTLVTVSA

SEQ ID NO: 1452 - protein, 119 aa, Artificial Sequence
  Description of Artificial Sequence: Synthetic heavy chain variable domain
EVQLVQSGAEVKKPGATVKISCKVSGFSLFNYGVHWVRQARGQRLEWIGVIWSGGNTDYNTPFTSRFTISRDDSKNTAYLQMNSLKTEDTAVYYCARALTYYDEEFAYWGPGTLVTVSS

SEQ ID NO: 1453 - protein, 119 aa, Artificial Sequence
  Description of Artificial Sequence: Synthetic heavy chain variable domain
EVQLVQSGAEVKKPGATVKISCKVSGFSLFNYGVHWVRQATGQGLEWMGVIWSGGNTDYNTPFTSRFTISRDDSKNTAYLQMNSLKTEDTAVYYCARALTYYDEEFAYWGPGTLVTVSA

SEQ ID NO: 1454 - protein, 119 aa, Artificial Sequence
  Description of Artificial Sequence: Synthetic heavy chain variable domain
EVQLVQSGAEVKKPGATVKISCKVSGFSLFNYGVHWVRQATGQGLEWMGVIWSGGNTDYNTPFTSRFTISRDDSKNTAYLQMNSLKTEDTAVYYCARALTYYDEEFAYWGPGTLVTVSS

SEQ ID NO: 1455 - protein, 119 aa, Artificial Sequence
  Description of Artificial Sequence: Synthetic heavy chain variable domain
EVQLVQSGAEVKKPGATVKISCKVSGFSLTNYGVHWIRQPPGKGLEWIGVIWSGGNTDYNTPFTSRFTISRDNAKNSLYLQMNSLRAEDTAVYYCARALTYYDEEFAYWGPGTLVTVSA

SEQ ID NO: 1456 - protein, 119 aa, Artificial Sequence
  Description of Artificial Sequence: Synthetic heavy chain variable domain
EVQLVQSGAEVKKPGATVKISCKVSGFSLTNYGVHWIRQPPGKGLEWIGVIWSGGNTDYNTPFTSRFTISRDNAKNSLYLQMNSLRAEDTAVYYCARALTYYDEEFAYWGPGTLVTVSS

SEQ ID NO: 1457 - protein, 119 aa, Artificial Sequence
  Description of Artificial Sequence: Synthetic heavy chain variable domain
EVQLVQSGAEVKKPGATVKISCKVSGFSLTNYGVHWIRQSPSRGLEWLGVIWSGGNTDYNTPFTSRLTISKDTSKNQVVLTMTNMDPVDTATYYCARALTYYDEEFAYWGPGTLVTVSA

SEQ ID NO: 1458 - protein, 119 aa, Artificial Sequence
  Description of Artificial Sequence: Synthetic heavy chain variable domain
EVQLVQSGAEVKKPGATVKISCKVSGFSLTNYGVHWIRQSPSRGLEWLGVIWSGGNTDYNTPFTSRLTISKDTSKNQVVLTMTNMDPVDTATYYCARALTYYDEEFAYWGPGTLVTVSS

SEQ ID NO: 1459 - protein, 119 aa, Artificial Sequence
  Description of Artificial Sequence: Synthetic heavy chain variable domain
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDEEFAYWGPGTLVTVSA

SEQ ID NO: 1460 - protein, 119 aa, Artificial Sequence
  Description of Artificial Sequence: Synthetic heavy chain variable domain
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDEEFAYWGPGTLVTVSS

SEQ ID NO: 1461 - protein, 119 aa, Artificial Sequence
  Description of Artificial Sequence: Synthetic heavy chain variable domain
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDEEFAYWGQGTLVTVSA

SEQ ID NO: 1462 - protein, 119 aa, Artificial Sequence
  Description of Artificial Sequence: Synthetic heavy chain variable domain
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDEEFAYWGQGTLVTVSS

SEQ ID NO: 1463 - protein, 119 aa, Artificial Sequence
  Description of Artificial Sequence: Synthetic heavy chain variable domain
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSA

SEQ ID NO: 1464 - protein, 119 aa, Artificial Sequence
  Description of Artificial Sequence: Synthetic heavy chain variable domain
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSS

SEQ ID NO: 1465 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDEEFAYWGPGTLVTVSA

SEQ ID NO: 1466 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDEEFAYWGPGTLVTVSS

SEQ ID NO: 1467 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDEEFAYWGQGTLVTVSA

SEQ ID NO: 1468 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDEEFAYWGQGTLVTVSS

SEQ ID NO: 1469 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDEEFAYWGPGTLVTVSA

SEQ ID NO: 1470 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDEEFAYWGPGTLVTVSS

SEQ ID NO: 1471 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDEEFAYWGQGTLVTVSA

SEQ ID NO: 1472 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDEEFAYWGQGTLVTVSS

SEQ ID NO: 1473 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDEEFAYWGPGTLVTVSA

SEQ ID NO: 1474 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDEEFAYWGPGTLVTVSS

SEQ ID NO: 1475 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDEEFAYWGQGTLVTVSA

SEQ ID NO: 1476 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDEEFAYWGQGTLVTVSS

SEQ ID NO: 1477 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDEEFAYWGPGTLVTVSA

SEQ ID NO: 1478 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDEEFAYWGPGTLVTVSS

SEQ ID NO: 1479 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDEEFAYWGQGTLVTVSA

SEQ ID NO: 1480 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDEEFAYWGQGTLVTVSS

SEQ ID NO: 1481 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDDEFAYWGQGTLVTVSS

SEQ ID NO: 1482 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSA

SEQ ID NO: 1483 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSS

SEQ ID NO: 1484 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDEEFAYWGPGTLVTVSA

SEQ ID NO: 1485 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDEEFAYWGPGTLVTVSS

SEQ ID NO: 1486 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDEEFAYWGQGTLVTVSA

SEQ ID NO: 1487 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDEEFAYWGQGTLVTVSS

SEQ ID NO: 1488 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDEEFAYWGPGTLVTVSA

SEQ ID NO: 1489 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDEEFAYWGPGTLVTVSS

SEQ ID NO: 1490 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDEEFAYWGQGTLVTVSA

SEQ ID NO: 1491 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDEEFAYWGQGTLVTVSS

SEQ ID NO: 1492 - protein, 119 aa, Artificial Sequence
  Description of Artificial Sequence: Synthetic heavy chain variable domain
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDEEFAYWGQGTLVTVSA

SEQ ID NO: 1493 - protein, 119 aa, Artificial Sequence
  Description of Artificial Sequence: Synthetic heavy chain variable domain
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDEEFAYWGQGTLVTVSS

SEQ ID NO: 1494 - protein, 119 aa, Artificial Sequence
  Description of Artificial Sequence: Synthetic heavy chain variable domain
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDEEFAYWGPGTLVTVSA

SEQ ID NO: 1495 - protein, 119 aa, Artificial Sequence
  Description of Artificial Sequence: Synthetic heavy chain variable domain
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDEEFAYWGPGTLVTVSS

SEQ ID NO: 1496 - protein, 119 aa, Artificial Sequence
  Description of Artificial Sequence: Synthetic heavy chain variable domain
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSA

SEQ ID NO: 1497 - protein, 119 aa, Artificial Sequence
  Description of Artificial Sequence: Synthetic heavy chain variable domain
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSS

SEQ ID NO: 1498 - protein, 119 aa, Artificial Sequence
  Description of Artificial Sequence: Synthetic heavy chain variable domain
QVQLQQSGPGLVKPSQTLSLTCAISGFSLTNYGVHWIRQPPGKGLEWIGVIWSGGNTDYNTPFTSRFTISRDDSKNTAYLQMNSLKTEDTAVYYCARALTYYDEEFAYWGPGTLVTVSA

SEQ ID NO: 1499 - protein, 119 aa, Artificial Sequence
  Description of Artificial Sequence: Synthetic heavy chain variable domain
QVQLQQSGPGLVKPSQTLSLTCAISGFSLFNYGVHWIRQSPSRGLEWLGVIWSGGNTDYNTPFTSRLTISKDTSKNQVVLTMTNMDPVDTATYYCARALTYYDEEFAYWGPGTLVTVSA

SEQ ID NO: 1500 - protein, 119 aa, Artificial Sequence
  Description of Artificial Sequence: Synthetic heavy chain variable domain
QVQLQQSGPGLVKPSQTLSLTCAISGFSLFNYGVHWIRQSPSRGLEWLGVIWSGGNTDYNTPFTSRLTISKDTSKNQVVLTMTNMDPVDTATYYCARALTYYDEEFAYWGPGTLVTVSS

SEQ ID NO: 1501 - protein, 119 aa, Artificial Sequence
  Description of Artificial Sequence: Synthetic heavy chain variable domain
QVQLQQSGPGLVKPSQTLSLTCAISGFSLTNYGVHWIRQPPGKGLEWIGVIWSGGNTDYNTPFTSRFTISRDDSKNTAYLQMNSLKTEDTAVYYCARALTYYDEEFAYWGPGTLVTVSS

SEQ ID NO: 1502 - protein, 118 aa, Artificial Sequence
  Description of Artificial Sequence: Synthetic heavy chain variable domain
VQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDEEFAYWGPGTLVTVSS

SEQ ID NO: 1503 - protein, 118 aa, Artificial Sequence
  Description of Artificial Sequence: Synthetic heavy chain variable domain
EVQLVESGGGLVQPGGSLRLSCAASGFTFSSYAMSWVRQAPGKGLEWVSAITGTGGETYYADSVKGRFTISRDNSKNTLYLQMNSLRAEDTAVYYCARGWSWTGVDPWGQGTLVTVSS

SEQ ID NO: 1504 - protein, 119 aa, Artificial Sequence
  Description of Artificial Sequence: Synthetic heavy chain variable domain
  MOD_RES (49)..(49): Any amino acid
  MOD_RES (54)..(54): Any amino acid
  MOD_RES (107)..(107): Any amino acid
EVQLVQSGAEVKKPGESLKISCKGSGYSFTSYWIGWVRQMPGKGLEWMXIIYPXDSDTRYSPSFQGQVTISADKSISTAYLQWSSLKASDTAMYYCARGIIYPSNVXVWGQGTLVTVSS

SEQ ID NO: 1505 - protein, 116 aa, Artificial Sequence
  Description of Artificial Sequence: Synthetic heavy chain variable domain
EVQLQESGPGLVKPSQTLSLTCTVSGYSIGKDFAWNWIRQPPGKGLEWMGYISYNGNTRYQPSLKSRITISRDTSKNQFFLKLNSVTAADTATYYCVTASRGFPYWGQGTLVTVSS

SEQ ID NO: 1506 - protein, 116 aa, Artificial Sequence
  Description of Artificial Sequence: Synthetic heavy chain variable domain
EVQLQESGPGLVKPSQTLSLTCTVSGYSIGKDFAWNWIRQPPGKGLEWMGYISYNGNTRYQPSLKSRITISRDTSKNQFFLKLNSVTAADTATYYCVTASRGLPYWGQGTLVTVSS

SEQ ID NO: 1507 - protein, 116 aa, Artificial Sequence
  Description of Artificial Sequence: Synthetic heavy chain variable domain
EVQLQESGPGLVKPSQTLSLTCTVSGYSIGKDFAWNWIRQPPGKGLEWMGYISYSGNTRYQPSLKSRITISRDTSKNQFFLKLNSVTAADTATYYCVTASRGLPYWGQGTLVTVSS

SEQ ID NO: 1508 - protein, 116 aa, Artificial Sequence
  Description of Artificial Sequence: Synthetic heavy chain variable domain
EVQLQESGPGLVKPSQTLSLTCTVSGYSIGRDFAWNWIRQPPGKGLEWMGYISYNGNTRYQPSLKSRITISRDTSKNQFFLKLNSVTAADTATYYCVTASRGFPYWGQGTLVTVSS

SEQ ID NO: 1509 - protein, 116 aa, Artificial Sequence
  Description of Artificial Sequence: Synthetic heavy chain variable domain
EVQLQESGPGLVKPSQTLSLTCTVSGYSIGRDFAWNWIRQPPGKGLEWMGYISYSGNTRYQPSLKSRITISRDTSKNQFFLKLNSVTAADTATYYCVTASRGFPYWGQGTLVTVSS

SEQ ID NO: 1510 - protein, 116 aa, Artificial Sequence
  Description of Artificial Sequence: Synthetic heavy chain variable domain
EVQLQESGPGLVKPSQTLSLTCTVSGYSISHDFAWNWIRQPPGKGLEWMGYISYNGNTRYQPSLKSRITISRDTSKNQFFLKLNSVTAADTATYYCVTASWGLPWWGQGTLVTVSS

SEQ ID NO: 1511 - protein, 116 aa, Artificial Sequence
  Description of Artificial Sequence: Synthetic heavy chain variable domain
EVQLQESGPGLVKPSQTLSLTCTVSGYSISHDFAWNWIRQPPGKGLEWMGYISYSGNTRYQPSLKSRITISRDTSKNQFFLKLNSVTAADTATYYCVTASWGLPWWGQGTLVTVSS

SEQ ID NO: 1512 - protein, 116 aa, Artificial Sequence
  Description of Artificial Sequence: Synthetic heavy chain variable domain
EVQLQESGPGLVKPSQTLSLTCTVSGYSISNDFAWNWIRQLPGKGLEWMGYISYKGNTRYQPSLKSRITISRDTSKNQFFLKLNSVTAADTATYYCVTASRGLPYWGQGTLVTVSS

SEQ ID NO: 1513 - protein, 116 aa, Artificial Sequence
  Description of Artificial Sequence: Synthetic heavy chain variable domain
EVQLQESGPGLVKPSQTLSLTCTVSGYSISNDFAWNWIRQPPGKGLEWMGYISYKGNTRYQPSLKSRITISRDTSKNQFFLKLNSVTAADTATYYCVTASRGFPWWGQGTLVTVSS

SEQ ID NO: 1514 - protein, 116 aa, Artificial Sequence
  Description of Artificial Sequence: Synthetic heavy chain variable domain
EVQLQESGPGLVKPSQTLSLTCTVSGYSISRDFAWNWIRQPPGKGLEWMGYISYNGNTRYQPSLKSRITISRDTSKNQFFLKLNSVTAADTATYYCVTASRGFPWWGQGTLVTVSS

SEQ ID NO: 1515 - protein, 116 aa, Artificial Sequence; identical to SEQ ID NO: 1398
  Description of Artificial Sequence: Synthetic heavy chain variable domain

SEQ ID NO: 1516 - protein, 116 aa, Artificial Sequence
  Description of Artificial Sequence: Synthetic heavy chain variable domain
EVQLQESGPGLVKPSQTLSLTCTVSGYSISRDFAWNWIRQPPGKGLEWMGYISYSGNTRYQPSLKSRITISRDTSKNQFFLKLNSVTAADTATYYCVTASRGFPYWGQGTLVTVSS

SEQ ID NO: 1517 - protein, 116 aa, Artificial Sequence; identical to SEQ ID NO: 1397
  Description of Artificial Sequence: Synthetic heavy chain variable domain

SEQ ID NO: 1518 - protein, 121 aa, Artificial Sequence
  Description of Artificial Sequence: Synthetic heavy chain variable domain
EVQLVESGGGLVQPGGSLRLSCAASGFTFSSYWMNWVRQAPGKGLEWVANIKKDGSEKYYVDSVKGRFTISRDNAKNSLYLQMNSLRAEDTAVYYCARDLGWGWGWYFDLWGRGTLVTVSS

SEQ ID NO: 1519 - protein, 117 aa, Artificial Sequence
  Description of Artificial Sequence: Synthetic heavy chain variable domain
EVQLVESGGGLVQPGGSLRLSCAASGFTFSSYWMSWVRQAPGKGLEWVANIKQDGSEENYVDSVKGRFTVSRDNAKNSLYLQMNSLRAEDTAVYYCARTYSGFEDYWGQGTLVTVSS

SEQ ID NO: 1520 - protein, 117 aa, Artificial Sequence
  Description of Artificial Sequence: Synthetic heavy chain variable domain
EVQLVESGGGLVQPGGSLRLSCAASGFTFSSYWMTWVRQAPGKGLEWVANIQQDGSEKNYLDSVKGRFTISRDNAKNSLSLQMNSLRAEDTAVYYCARTYSGFEDFWGQGTLVTVSS

SEQ ID NO: 1521 - protein, 117 aa, Artificial Sequence
  Description of Artificial Sequence: Synthetic heavy chain variable domain
EVQLVESGGGLVQPGGSLRLSCAASRFTFSDYWMTWVRQAPGKGLEWVAHIKQDGSEKYYVDSVKGRFTISRDNAKNSLYLQMNSLRAEDTALYYCARGFLIYFDYWGQGTLVTVSS

SEQ ID NO: 1522 - protein, 117 aa, Artificial Sequence
  Description of Artificial Sequence: Synthetic heavy chain variable domain
EVKLVESGGGLVQPGGSLRLSCATSGFTFTDYYMSWVRQPPGKGLEWLGFIRNKANGYTTEYSASVKGRFTISRDNSKSTLYLQMNSLRAEDSATYYCARDNWFAYWGQGTLVTVSS

SEQ ID NO: 1523 - protein, 117 aa, Artificial Sequence
  Description of Artificial Sequence: Synthetic heavy chain variable domain
EVKLVESGGGLVQPGGSLRLSCATSGFTFTDYYMSWVRQPPGKGLEWLGFIRNKANGYTTEYSASVKGRFTISRDNSKSTLYLQMNSLRAEDTATYYCARDNWFAYWGQGTLVTVSS

SEQ ID NO: 1524 - protein, 117 aa, Artificial Sequence
  Description of Artificial Sequence: Synthetic heavy chain variable domain
EVQLVESGGGLVQPGGSLRLSCATSGFTFTDYYMSWVRQPPGKGLEWLGFIRNKANGYTTEYSASVKGRFTISRDNSKNTLYLQMNSLRAEDTATYYCARDNWFAYWGQGTLVTVSS

SEQ ID NO: 1525 - protein, 117 aa, Artificial Sequence
  Description of Artificial Sequence: Synthetic heavy chain variable domain
EVQLVESGGGLVQPGGSLRLSCATSGFTFTDYYMSWVRQPPGKGLEWLGFIRNKANGYTTEYSASVKGRFTISRDNSKNTLYLQMNSLRAEDTAVYYCARDNWFAYWGQGTLVTVSS

SEQ ID NO: 1526 - protein, 117 aa, Artificial Sequence
  Description of Artificial Sequence: Synthetic heavy chain variable domain
EVQLVESGGGLVQPGGSLRLSCATSGFTFTDYYMSWVRQPPGKGLEWLGFIRNKANGYTTEYSASVKGRFTISRDNSKSTLYLQMNSLRAEDTATYYCARDNWFAYWGQGTLVTVSS

SEQ ID NO: 1527 - protein, 120 aa, Artificial Sequence
  Description of Artificial Sequence: Synthetic heavy chain variable domain
QVQLVQSGAEVKKPGSSVKVSCKASGFTFTDYKIHWVRQAPGQCLEWMGYINPNSGYSTYASKFQGRVTITADKSTSTAYMELSSLRSEDTAVYYCARLSPGGYYVMDAWGQGTTVTVSS

SEQ ID NO: 1528 - protein, 118 aa, Artificial Sequence
  Description of Artificial Sequence: Synthetic heavy chain variable domain
LVTLKVCGPGILQPSQTLSLTCSFSGFSLSTSGMGVGWLRQPSGKSLEWLAHIWWDDDKRYNPALKSRLTISKDTSSNQVFLKIASVDTTDTATYYCARMGMTGYFDFWGQGTTLTVS

SEQ ID NO: 1529 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLGINKDNSKSQVFFKMNSLQSNDTAIYYCARALTYYDYEFAYWGQGTLVTVSA

SEQ ID NO: 1530 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLTINKDNSKSQVFFKMNSLQSNDTAIYYCARALTYYDYEFAYWGQGTLVTVSA

SEQ ID NO: 1531 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWHGGNTDYNTPFTSRLSINKDNSKSQVFFKMNSLQSNDTAIYYCARALTYYDYEFAYWGQGTLVTVSA

SEQ ID NO: 1532 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWIGGNTDYNTPFTSRLSINKDNSKSQVFFKMNSLQSNDTAIYYCARALTYYDYEFAYWGQGTLVTVSA

SEQ ID NO: 1533 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWLGGNTDYNTPFTSRLSINKDNSKSQVFFKMNSLQSNDTAIYYCARALTYYDYEFAYWGQGTLVTVSA

SEQ ID NO: 1534 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWMGGNTDYNTPFTSRLSINKDNSKSQVFFKMNSLQSNDTAIYYCARALTYYDYEFAYWGQGTLVTVSA

SEQ ID NO: 1535 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWPGGNTDYNTPFTSRLSINKDNSKSQVFFKMNSLQSNDTAIYYCARALTYYDYEFAYWGQGTLVTVSA

SEQ ID NO: 1536 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWQGGNTDYNTPFTSRLSINKDNSKSQVFFKMNSLQSNDTAIYYCARALTYYDYEFAYWGQGTLVTVSA

SEQ ID NO: 1537 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWRGGNTDYNTPFTSRLSINKDNSKSQVFFKMNSLQSNDTAIYYCARALTYYDYEFAYWGQGTLVTVSA

SEQ ID NO: 1538 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSAGNTDYNTPFTSRLSINKDNSKSQVFFKMNSLQSNDTAIYYCARALTYYDYEFAYWGQGTLVTVSA

SEQ ID NO: 1539 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSCGNTDYNTPFTSRLSINKDNSKSQVFFKMNSLQSNDTAIYYCARALTYYDYEFAYWGQGTLVTVSA

SEQ ID NO: 1540 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSDGNTDYNTPFTSRLSINKDNSKSQVFFKMNSLQSNDTAIYYCARALTYYDYEFAYWGQGTLVTVSA

SEQ ID NO: 1541 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGATDYNTPFTSRLSINKDNSKSQVFFKMNSLQSNDTAIYYCARALTYYDYEFAYWGQGTLVTVSA

SEQ ID NO: 1542 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGGTDYNTPFTSRLSINKDNSKSQVFFKMNSLQSNDTAIYYCARALTYYDYEFAYWGQGTLVTVSA

SEQ ID NO: 1543 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGKTDYNTPFTSRLSINKDNSKSQVFFKMNSLQSNDTAIYYCARALTYYDYEFAYWGQGTLVTVSA

SEQ ID NO: 1544 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNADYNTPFTSRLSINKDNSKSQVFFKMNSLQSNDTAIYYCARALTYYDYEFAYWGQGTLVTVSA

SEQ ID NO: 1545 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNCDYNTPFTSRLSINKDNSKSQVFFKMNSLQSNDTAIYYCARALTYYDYEFAYWGQGTLVTVSA

SEQ ID NO: 1546 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNDDYNTPFTSRLSINKDNSKSQVFFKMNSLQSNDTAIYYCARALTYYDYEFAYWGQGTLVTVSA

SEQ ID NO: 1547 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNFDYNTPFTSRLSINKDNSKSQVFFKMNSLQSNDTAIYYCARALTYYDYEFAYWGQGTLVTVSA

SEQ ID NO: 1548 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNHDYNTPFTSRLSINKDNSKSQVFFKMNSLQSNDTAIYYCARALTYYDYEFAYWGQGTLVTVSA

SEQ ID NO: 1549 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNLDYNTPFTSRLSINKDNSKSQVFFKMNSLQSNDTAIYYCARALTYYDYEFAYWGQGTLVTVSA

SEQ ID NO: 1550 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNMDYNTPFTSRLSINKDNSKSQVFFKMNSLQSNDTAIYYCARALTYYDYEFAYWGQGTLVTVSA

SEQ ID NO: 1551 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNNDYNTPFTSRLSINKDNSKSQVFFKMNSLQSNDTAIYYCARALTYYDYEFAYWGQGTLVTVSA

SEQ ID NO: 1552 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNQDYNTPFTSRLSINKDNSKSQVFFKMNSLQSNDTAIYYCARALTYYDYEFAYWGQGTLVTVSA

SEQ ID NO: 1553 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNRDYNTPFTSRLSINKDNSKSQVFFKMNSLQSNDTAIYYCARALTYYDYEFAYWGQGTLVTVSA

SEQ ID NO: 1554 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDANTPFTSRLSINKDNSKSQVFFKMNSLQSNDTAIYYCARALTYYDYEFAYWGQGTLVTVSA

SEQ ID NO: 1555 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDCNTPFTSRLSINKDNSKSQVFFKMNSLQSNDTAIYYCARALTYYDYEFAYWGQGTLVTVSA

SEQ ID NO: 1556 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDDNTPFTSRLSINKDNSKSQVFFKMNSLQSNDTAIYYCARALTYYDYEFAYWGQGTLVTVSA

SEQ ID NO: 1557 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDENTPFTSRLSINKDNSKSQVFFKMNSLQSNDTAIYYCARALTYYDYEFAYWGQGTLVTVSA

SEQ ID NO: 1558 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDGNTPFTSRLSINKDNSKSQVFFKMNSLQSNDTAIYYCARALTYYDYEFAYWGQGTLVTVSA

SEQ ID NO: 1559 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDHNTPFTSRLSINKDNSKSQVFFKMNSLQSNDTAIYYCARALTYYDYEFAYWGQGTLVTVSA

SEQ ID NO: 1560 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDINTPFTSRLSINKDNSKSQVFFKMNSLQSNDTAIYYCARALTYYDYEFAYWGQGTLVTVSA

SEQ ID NO: 1561 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDPNTPFTSRLSINKDNSKSQVFFKMNSLQSNDTAIYYCARALTYYDYEFAYWGQGTLVTVSA

SEQ ID NO: 1562 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDQNTPFTSRLSINKDNSKSQVFFKMNSLQSNDTAIYYCARALTYYDYEFAYWGQGTLVTVSA

SEQ ID NO: 1563 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDRNTPFTSRLSINKDNSKSQVFFKMNSLQSNDTAIYYCARALTYYDYEFAYWGQGTLVTVSA

SEQ ID NO: 1564 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDSNTPFTSRLSINKDNSKSQVFFKMNSLQSNDTAIYYCARALTYYDYEFAYWGQGTLVTVSA

SEQ ID NO: 1565 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDTNTPFTSRLSINKDNSKSQVFFKMNSLQSNDTAIYYCARALTYYDYEFAYWGQGTLVTVSA

SEQ ID NO: 1566 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDVNTPFTSRLSINKDNSKSQVFFKMNSLQSNDTAIYYCARALTYYDYEFAYWGQGTLVTVSA

SEQ ID NO: 1567 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDWNTPFTSRLSINKDNSKSQVFFKMNSLQSNDTAIYYCARALTYYDYEFAYWGQGTLVTVSA

SEQ ID NO: 1568 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYATPFTSRLSINKDNSKSQVFFKMNSLQSNDTAIYYCARALTYYDYEFAYWGQGTLVTVSA

SEQ ID NO: 1569 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYCTPFTSRLSINKDNSKSQVFFKMNSLQSNDTAIYYCARALTYYDYEFAYWGQGTLVTVSA

SEQ ID NO: 1570 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYDTPFTSRLSINKDNSKSQVFFKMNSLQSNDTAIYYCARALTYYDYEFAYWGQGTLVTVSA

SEQ ID NO: 1571 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYFTPFTSRLSINKDNSKSQVFFKMNSLQSNDTAIYYCARALTYYDYEFAYWGQGTLVTVSA

SEQ ID NO: 1572 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYGTPFTSRLSINKDNSKSQVFFKMNSLQSNDTAIYYCARALTYYDYEFAYWGQGTLVTVSA

SEQ ID NO: 1573 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYKTPFTSRLSINKDNSKSQVFFKMNSLQSNDTAIYYCARALTYYDYEFAYWGQGTLVTVSA

SEQ ID NO: 1574 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNNPFTSRLSINKDNSKSQVFFKMNSLQSNDTAIYYCARALTYYDYEFAYWGQGTLVTVSA

SEQ ID NO: 1575 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNQPFTSRLSINKDNSKSQVFFKMNSLQSNDTAIYYCARALTYYDYEFAYWGQGTLVTVSA

SEQ ID NO: 1576 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTGFTSRLSINKDNSKSQVFFKMNSLQSNDTAIYYCARALTYYDYEFAYWGQGTLVTVSA

SEQ ID NO: 1577 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPATSRLSINKDNSKSQVFFKMNSLQSNDTAIYYCARALTYYDYEFAYWGQGTLVTVSA

SEQ ID NO: 1578 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPCTSRLSINKDNSKSQVFFKMNSLQSNDTAIYYCARALTYYDYEFAYWGQGTLVTVSA

SEQ ID NO: 1579 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPDTSRLSINKDNSKSQVFFKMNSLQSNDTAIYYCARALTYYDYEFAYWGQGTLVTVSA

SEQ ID NO: 1580 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFCSRLSINKDNSKSQVFFKMNSLQSNDTAIYYCARALTYYDYEFAYWGQGTLVTVSA

SEQ ID NO: 1581 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFFSRLSINKDNSKSQVFFKMNSLQSNDTAIYYCARALTYYDYEFAYWGQGTLVTVSA

SEQ ID NO: 1582 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFGSRLSINKDNSKSQVFFKMNSLQSNDTAIYYCARALTYYDYEFAYWGQGTLVTVSA

SEQ ID NO: 1583 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFLSRLSINKDNSKSQVFFKMNSLQSNDTAIYYCARALTYYDYEFAYWGQGTLVTVSA

SEQ ID NO: 1584 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFNSRLSINKDNSKSQVFFKMNSLQSNDTAIYYCARALTYYDYEFAYWGQGTLVTVSA

SEQ ID NO: 1585 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFQSRLSINKDNSKSQVFFKMNSLQSNDTAIYYCARALTYYDYEFAYWGQGTLVTVSA

SEQ ID NO: 1586 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFRSRLSINKDNSKSQVFFKMNSLQSNDTAIYYCARALTYYDYEFAYWGQGTLVTVSA

SEQ ID NO: 1587 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTCRLSINKDNSKSQVFFKMNSLQSNDTAIYYCARALTYYDYEFAYWGQGTLVTVSA

SEQ ID NO: 1588 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTERLSINKDNSKSQVFFKMNSLQSNDTAIYYCARALTYYDYEFAYWGQGTLVTVSA

SEQ ID NO: 1589 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTFRLSINKDNSKSQVFFKMNSLQSNDTAIYYCARALTYYDYEFAYWGQGTLVTVSA

SEQ ID NO: 1590 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTGRLSINKDNSKSQVFFKMNSLQSNDTAIYYCARALTYYDYEFAYWGQGTLVTVSA

SEQ ID NO: 1591 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTHRLSINKDNSKSQVFFKMNSLQSNDTAIYYCARALTYYDYEFAYWGQGTLVTVSA

SEQ ID NO: 1592 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTIRLSINKDNSKSQVFFKMNSLQSNDTAIYYCARALTYYDYEFAYWGQGTLVTVSA

SEQ ID NO: 1593 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTLRLSINKDNSKSQVFFKMNSLQSNDTAIYYCARALTYYDYEFAYWGQGTLVTVSA

SEQ ID NO: 1594 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTMRLSINKDNSKSQVFFKMNSLQSNDTAIYYCARALTYYDYEFAYWGQGTLVTVSA

SEQ ID NO: 1595 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTNRLSINKDNSKSQVFFKMNSLQSNDTAIYYCARALTYYDYEFAYWGQGTLVTVSA

SEQ ID NO: 1596 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTPRLSINKDNSKSQVFFKMNSLQSNDTAIYYCARALTYYDYEFAYWGQGTLVTVSA

SEQ ID NO: 1597 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTQRLSINKDNSKSQVFFKMNSLQSNDTAIYYCARALTYYDYEFAYWGQGTLVTVSA

SEQ ID NO: 1598 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTRRLSINKDNSKSQVFFKMNSLQSNDTAIYYCARALTYYDYEFAYWGQGTLVTVSA

SEQ ID NO: 1599 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSALSINKDNSKSQVFFKMNSLQSNDTAIYYCARALTYYDYEFAYWGQGTLVTVSA

SEQ ID NO: 1600 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSCLSINKDNSKSQVFFKMNSLQSNDTAIYYCARALTYYDYEFAYWGQGTLVTVSA

SEQ ID NO: 1601 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSELSINKDNSKSQVFFKMNSLQSNDTAIYYCARALTYYDYEFAYWGQGTLVTVSA

SEQ ID NO: 1602 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSFLSINKDNSKSQVFFKMNSLQSNDTAIYYCARALTYYDYEFAYWGQGTLVTVSA

SEQ ID NO: 1603 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSGLSINKDNSKSQVFFKMNSLQSNDTAIYYCARALTYYDYEFAYWGQGTLVTVSA

SEQ ID NO: 1604 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSLLSINKDNSKSQVFFKMNSLQSNDTAIYYCARALTYYDYEFAYWGQGTLVTVSA

SEQ ID NO: 1605 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSNLSINKDNSKSQVFFKMNSLQSNDTAIYYCARALTYYDYEFAYWGQGTLVTVSA

SEQ ID NO: 1606 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSPLSINKDNSKSQVFFKMNSLQSNDTAIYYCARALTYYDYEFAYWGQGTLVTVSA

SEQ ID NO: 1607 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSQLSINKDNSKSQVFFKMNSLQSNDTAIYYCARALTYYDYEFAYWGQGTLVTVSA

SEQ ID NO: 1608 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRASINKDNSKSQVFFKMNSLQSNDTAIYYCARALTYYDYEFAYWGQGTLVTVSA

SEQ ID NO: 1609 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRCSINKDNSKSQVFFKMNSLQSNDTAIYYCARALTYYDYEFAYWGQGTLVTVSA

SEQ ID NO: 1610 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRDSINKDNSKSQVFFKMNSLQSNDTAIYYCARALTYYDYEFAYWGQGTLVTVSA

SEQ ID NO: 1611 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRESINKDNSKSQVFFKMNSLQSNDTAIYYCARALTYYDYEFAYWGQGTLVTVSA

SEQ ID NO: 1612 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRGSINKDNSKSQVFFKMNSLQSNDTAIYYCARALTYYDYEFAYWGQGTLVTVSA

SEQ ID NO: 1613 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRISINKDNSKSQVFFKMNSLQSNDTAIYYCARALTYYDYEFAYWGQGTLVTVSA

SEQ ID NO: 1614 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLCINKDNSKSQVFFKMNSLQSNDTAIYYCARALTYYDYEFAYWGQGTLVTVSA

SEQ ID NO: 1615 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLDINKDNSKSQVFFKMNSLQSNDTAIYYCARALTYYDYEFAYWGQGTLVTVSA

SEQ ID NO: 1616 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLEINKDNSKSQVFFKMNSLQSNDTAIYYCARALTYYDYEFAYWGQGTLVTVSA

SEQ ID NO: 1617 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLFINKDNSKSQVFFKMNSLQSNDTAIYYCARALTYYDYEFAYWGQGTLVTVSA

SEQ ID NO: 1618 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLHINKDNSKSQVFFKMNSLQSNDTAIYYCARALTYYDYEFAYWGQGTLVTVSA

SEQ ID NO: 1619 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLIINKDNSKSQVFFKMNSLQSNDTAIYYCARALTYYDYEFAYWGQGTLVTVSA

SEQ ID NO: 1620 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLKINKDNSKSQVFFKMNSLQSNDTAIYYCARALTYYDYEFAYWGQGTLVTVSA

SEQ ID NO: 1621 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLLINKDNSKSQVFFKMNSLQSNDTAIYYCARALTYYDYEFAYWGQGTLVTVSA

SEQ ID NO: 1622 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLNINKDNSKSQVFFKMNSLQSNDTAIYYCARALTYYDYEFAYWGQGTLVTVSA

SEQ ID NO: 1623 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLQINKDNSKSQVFFKMNSLQSNDTAIYYCARALTYYDYEFAYWGQGTLVTVSA

SEQ ID NO: 1624 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLRINKDNSKSQVFFKMNSLQSNDTAIYYCARALTYYDYEFAYWGQGTLVTVSA

SEQ ID NO: 1625 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSANKDNSKSQVFFKMNSLQSNDTAIYYCARALTYYDYEFAYWGQGTLVTVSA

SEQ ID NO: 1626 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSCNKDNSKSQVFFKMNSLQSNDTAIYYCARALTYYDYEFAYWGQGTLVTVSA

SEQ ID NO: 1627 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSGNKDNSKSQVFFKMNSLQSNDTAIYYCARALTYYDYEFAYWGQGTLVTVSA

SEQ ID NO: 1628 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSIDKDNSKSQVFFKMNSLQSNDTAIYYCARALTYYDYEFAYWGQGTLVTVSA

SEQ ID NO: 1629 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSIEKDNSKSQVFFKMNSLQSNDTAIYYCARALTYYDYEFAYWGQGTLVTVSA

SEQ ID NO: 1630 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSIFKDNSKSQVFFKMNSLQSNDTAIYYCARALTYYDYEFAYWGQGTLVTVSA

SEQ ID NO: 1631 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSIGKDNSKSQVFFKMNSLQSNDTAIYYCARALTYYDYEFAYWGQGTLVTVSA

SEQ ID NO: 1632 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSIHKDNSKSQVFFKMNSLQSNDTAIYYCARALTYYDYEFAYWGQGTLVTVSA

SEQ ID NO: 1633 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSIIKDNSKSQVFFKMNSLQSNDTAIYYCARALTYYDYEFAYWGQGTLVTVSA

SEQ ID NO: 1634 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSILKDNSKSQVFFKMNSLQSNDTAIYYCARALTYYDYEFAYWGQGTLVTVSA

SEQ ID NO: 1635 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINADNSKSQVFFKMNSLQSNDTAIYYCARALTYYDYEFAYWGQGTLVTVSA

SEQ ID NO: 1636 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINCDNSKSQVFFKMNSLQSNDTAIYYCARALTYYDYEFAYWGQGTLVTVSA

SEQ ID NO: 1637 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINFDNSKSQVFFKMNSLQSNDTAIYYCARALTYYDYEFAYWGQGTLVTVSA

SEQ ID NO: 1638 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINGDNSKSQVFFKMNSLQSNDTAIYYCARALTYYDYEFAYWGQGTLVTVSA

SEQ ID NO: 1639 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINHDNSKSQVFFKMNSLQSNDTAIYYCARALTYYDYEFAYWGQGTLVTVSA

SEQ ID NO: 1640 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKANSKSQVFFKMNSLQSNDTAIYYCARALTYYDYEFAYWGQGTLVTVSA

SEQ ID NO: 1641 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDASKSQVFFKMNSLQSNDTAIYYCARALTYYDYEFAYWGQGTLVTVSA

SEQ ID NO: 1642 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDCSKSQVFFKMNSLQSNDTAIYYCARALTYYDYEFAYWGQGTLVTVSA

SEQ ID NO: 1643 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDGSKSQVFFKMNSLQSNDTAIYYCARALTYYDYEFAYWGQGTLVTVSA

SEQ ID NO: 1644 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDHSKSQVFFKMNSLQSNDTAIYYCARALTYYDYEFAYWGQGTLVTVSA

SEQ ID NO: 1645 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDISKSQVFFKMNSLQSNDTAIYYCARALTYYDYEFAYWGQGTLVTVSA

SEQ ID NO: 1646 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDLSKSQVFFKMNSLQSNDTAIYYCARALTYYDYEFAYWGQGTLVTVSA

SEQ ID NO: 1647 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDMSKSQVFFKMNSLQSNDTAIYYCARALTYYDYEFAYWGQGTLVTVSA

SEQ ID NO: 1648 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNAKSQVFFKMNSLQSNDTAIYYCARALTYYDYEFAYWGQGTLVTVSA

SEQ ID NO: 1649 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNCKSQVFFKMNSLQSNDTAIYYCARALTYYDYEFAYWGQGTLVTVSA

SEQ ID NO: 1650 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNDKSQVFFKMNSLQSNDTAIYYCARALTYYDYEFAYWGQGTLVTVSA

SEQ ID NO: 1651 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNEKSQVFFKMNSLQSNDTAIYYCARALTYYDYEFAYWGQGTLVTVSA

SEQ ID NO: 1652 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNGKSQVFFKMNSLQSNDTAIYYCARALTYYDYEFAYWGQGTLVTVSA

SEQ ID NO: 1653 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNHKSQVFFKMNSLQSNDTAIYYCARALTYYDYEFAYWGQGTLVTVSA

SEQ ID NO: 1654 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNIKSQVFFKMNSLQSNDTAIYYCARALTYYDYEFAYWGQGTLVTVSA

SEQ ID NO: 1655 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNKKSQVFFKMNSLQSNDTAIYYCARALTYYDYEFAYWGQGTLVTVSA

SEQ ID NO: 1656 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNLKSQVFFKMNSLQSNDTAIYYCARALTYYDYEFAYWGQGTLVTVSA

SEQ ID NO: 1657 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNMKSQVFFKMNSLQSNDTAIYYCARALTYYDYEFAYWGQGTLVTVSA

SEQ ID NO: 1658 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNPKSQVFFKMNSLQSNDTAIYYCARALTYYDYEFAYWGQGTLVTVSA

SEQ ID NO: 1659 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNRKSQVFFKMNSLQSNDTAIYYCARALTYYDYEFAYWGQGTLVTVSA

SEQ ID NO: 1660 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSASQVFFKMNSLQSNDTAIYYCARALTYYDYEFAYWGQGTLVTVSA

SEQ ID NO: 1661 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSCSQVFFKMNSLQSNDTAIYYCARALTYYDYEFAYWGQGTLVTVSA

SEQ ID NO: 1662 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSESQVFFKMNSLQSNDTAIYYCARALTYYDYEFAYWGQGTLVTVSA

SEQ ID NO: 1663 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSFSQVFFKMNSLQSNDTAIYYCARALTYYDYEFAYWGQGTLVTVSA

SEQ ID NO: 1664 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSGSQVFFKMNSLQSNDTAIYYCARALTYYDYEFAYWGQGTLVTVSA

SEQ ID NO: 1665 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSHSQVFFKMNSLQSNDTAIYYCARALTYYDYEFAYWGQGTLVTVSA

SEQ ID NO: 1666 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKAQVFFKMNSLQSNDTAIYYCARALTYYDYEFAYWGQGTLVTVSA

SEQ ID NO: 1667 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKCQVFFKMNSLQSNDTAIYYCARALTYYDYEFAYWGQGTLVTVSA

SEQ ID NO: 1668 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKDQVFFKMNSLQSNDTAIYYCARALTYYDYEFAYWGQGTLVTVSA

SEQ ID NO: 1669 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKEQVFFKMNSLQSNDTAIYYCARALTYYDYEFAYWGQGTLVTVSA

SEQ ID NO: 1670 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKFQVFFKMNSLQSNDTAIYYCARALTYYDYEFAYWGQGTLVTVSA

SEQ ID NO: 1671 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKHQVFFKMNSLQSNDTAIYYCARALTYYDYEFAYWGQGTLVTVSA

SEQ ID NO: 1672 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKIQVFFKMNSLQSNDTAIYYCARALTYYDYEFAYWGQGTLVTVSA

SEQ ID NO: 1673 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKLQVFFKMNSLQSNDTAIYYCARALTYYDYEFAYWGQGTLVTVSA

SEQ ID NO: 1674 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKMQVFFKMNSLQSNDTAIYYCARALTYYDYEFAYWGQGTLVTVSA

SEQ ID NO: 1675 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKPQVFFKMNSLQSNDTAIYYCARALTYYDYEFAYWGQGTLVTVSA

SEQ ID NO: 1676 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKQQVFFKMNSLQSNDTAIYYCARALTYYDYEFAYWGQGTLVTVSA

SEQ ID NO: 1677 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKRQVFFKMNSLQSNDTAIYYCARALTYYDYEFAYWGQGTLVTVSA

SEQ ID NO: 1678 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSAVFFKMNSLQSNDTAIYYCARALTYYDYEFAYWGQGTLVTVSA

SEQ ID NO: 1679 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSEVFFKMNSLQSNDTAIYYCARALTYYDYEFAYWGQGTLVTVSA

SEQ ID NO: 1680 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSGVFFKMNSLQSNDTAIYYCARALTYYDYEFAYWGQGTLVTVSA

SEQ ID NO: 1681 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSHVFFKMNSLQSNDTAIYYCARALTYYDYEFAYWGQGTLVTVSA

SEQ ID NO: 1682 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSIVFFKMNSLQSNDTAIYYCARALTYYDYEFAYWGQGTLVTVSA

SEQ ID NO: 1683 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSLVFFKMNSLQSNDTAIYYCARALTYYDYEFAYWGQGTLVTVSA

SEQ ID NO: 1684 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSMVFFKMNSLQSNDTAIYYCARALTYYDYEFAYWGQGTLVTVSA

SEQ ID NO: 1685 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSNVFFKMNSLQSNDTAIYYCARALTYYDYEFAYWGQGTLVTVSA

SEQ ID NO: 1686 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIHYCARALTYYDYEFAYWGQGTLVTVSA

SEQ ID NO: 1687 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIVYCARALTYYDYEFAYWGQGTLVTVSA

SEQ ID NO: 1688 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIWYCARALTYYDYEFAYWGQGTLVTVSA

SEQ ID NO: 1689 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYLCARALTYYDYEFAYWGQGTLVTVSA

SEQ ID NO: 1690 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYRCARALTYYDYEFAYWGQGTLVTVSA

SEQ ID NO: 1691 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCAHALTYYDYEFAYWGQGTLVTVSA

SEQ ID NO: 1692 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALAYYDYEFAYWGQGTLVTVSA

SEQ ID NO: 1693 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALDYYDYEFAYWGQGTLVTVSA

SEQ ID NO: 1694 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALHYYDYEFAYWGQGTLVTVSA

SEQ ID NO: 1695 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALIYYDYEFAYWGQGTLVTVSA

SEQ ID NO: 1696 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALLYYDYEFAYWGQGTLVTVSA

SEQ ID NO: 1697 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALNYYDYEFAYWGQGTLVTVSA

SEQ ID NO: 1698 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALPYYDYEFAYWGQGTLVTVSA

SEQ ID NO: 1699 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALQYYDYEFAYWGQGTLVTVSA

SEQ ID NO: 1700 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALSYYDYEFAYWGQGTLVTVSA

SEQ ID NO: 1701 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTEYDYEFAYWGQGTLVTVSA

SEQ ID NO: 1702 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTFYDYEFAYWGQGTLVTVSA

SEQ ID NO: 1703 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTHYDYEFAYWGQGTLVTVSA

SEQ ID NO: 1704 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTMYDYEFAYWGQGTLVTVSA

SEQ ID NO: 1705 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTWYDYEFAYWGQGTLVTVSA

SEQ ID NO: 1706 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYCDYEFAYWGQGTLVTVSA

SEQ ID NO: 1707 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYDDYEFAYWGQGTLVTVSA

SEQ ID NO: 1708 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYIDYEFAYWGQGTLVTVSA

SEQ ID NO: 1709 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYNDYEFAYWGQGTLVTVSA

SEQ ID NO: 1710 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYRDYEFAYWGQGTLVTVSA

SEQ ID NO: 1711 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYWDYEFAYWGQGTLVTVSA

SEQ ID NO: 1712 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYAYEFAYWGQGTLVTVSA

SEQ ID NO: 1713 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYCYEFAYWGQGTLVTVSA

SEQ ID NO: 1714 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDDEFAYWGPGTLVTVSA

SEQ ID NO: 1715 - protein, 119 aa, Artificial Sequence
  Description of Artificial Sequence: Synthetic heavy chain variable domain
QVQLKQSGPGLVQPSQSLSITCTVSGFSLGNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1716 - protein, 119 aa, Artificial Sequence
  Description of Artificial Sequence: Synthetic heavy chain variable domain
QVQLKQSGPGLVQPSQSLSITCTVSGFSLHNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1717 - protein, 119 aa, Artificial Sequence
  Description of Artificial Sequence: Synthetic heavy chain variable domain
QVQLKQSGPGLVQPSQSLSITCTVSGFSLINYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1718 - protein, 119 aa, Artificial Sequence
  Description of Artificial Sequence: Synthetic heavy chain variable domain
QVQLKQSGPGLVQPSQSLSITCTVSGFSLMNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1719 - protein, 119 aa, Artificial Sequence
  Description of Artificial Sequence: Synthetic heavy chain variable domain
QVQLKQSGPGLVQPSQSLSITCTVSGFSLNNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1720 - protein, 119 aa, Artificial Sequence
  Description of Artificial Sequence: Synthetic heavy chain variable domain
QVQLKQSGPGLVQPSQSLSITCTVSGFSLPNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1721 - protein, 119 aa, Artificial Sequence
  Description of Artificial Sequence: Synthetic heavy chain variable domain
QVQLKQSGPGLVQPSQSLSITCTVSGFSLRNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1722 - protein, 119 aa, Artificial Sequence
  Description of Artificial Sequence: Synthetic heavy chain variable domain
QVQLKQSGPGLVQPSQSLSITCTVSGFSLSNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1723 - protein, 119 aa, Artificial Sequence
  Description of Artificial Sequence: Synthetic heavy chain variable domain
QVQLKQSGPGLVQPSQSLSITCTVSGFSLTDYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1724 - protein, 119 aa, Artificial Sequence
  Description of Artificial Sequence: Synthetic heavy chain variable domain
QVQLKQSGPGLVQPSQSLSITCTVSGFSLTEYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1725 - protein, 119 aa, Artificial Sequence
  Description of Artificial Sequence: Synthetic heavy chain variable domain
QVQLKQSGPGLVQPSQSLSITCTVSGFSLTGYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1726 - protein, 119 aa, Artificial Sequence
  Description of Artificial Sequence: Synthetic heavy chain variable domain
QVQLKQSGPGLVQPSQSLSITCTVSGFSLTHYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1727 - protein, 119 aa, Artificial Sequence
  Description of Artificial Sequence: Synthetic heavy chain variable domain
QVQLKQSGPGLVQPSQSLSITCTVSGFSLTIYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1728 - protein, 119 aa, Artificial Sequence
  Description of Artificial Sequence: Synthetic heavy chain variable domain
QVQLKQSGPGLVQPSQSLSITCTVSGFSLTKYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1729 - protein, 119 aa, Artificial Sequence
  Description of Artificial Sequence: Synthetic heavy chain variable domain
QVQLKQSGPGLVQPSQSLSITCTVSGFSLTLYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1730 - protein, 119 aa, Artificial Sequence
  Description of Artificial Sequence: Synthetic heavy chain variable domain
QVQLKQSGPGLVQPSQSLSITCTVSGFSLTNCGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1731 - protein, 119 aa, Artificial Sequence
  Description of Artificial Sequence: Synthetic heavy chain variable domain
QVQLKQSGPGLVQPSQSLSITCTVSGFSLTNHGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1732 - protein, 119 aa, Artificial Sequence
  Description of Artificial Sequence: Synthetic heavy chain variable domain
QVQLKQSGPGLVQPSQSLSITCTVSGFSLTNLGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1733 - protein, 119 aa, Artificial Sequence
  Description of Artificial Sequence: Synthetic heavy chain variable domain
QVQLKQSGPGLVQPSQSLSITCTVSGFSLTNMGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1734 - protein, 119 aa, Artificial Sequence
  Description of Artificial Sequence: Synthetic heavy chain variable domain
QVQLKQSGPGLVQPSQSLSITCTVSGFSLTNNGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1735 - protein, 119 aa, Artificial Sequence
  Description of Artificial Sequence: Synthetic heavy chain variable domain
QVQLKQSGPGLVQPSQSLSITCTVSGFSLTNRGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1736 - protein, 119 aa, Artificial Sequence
  Description of Artificial Sequence: Synthetic heavy chain variable domain
QVQLKQSGPGLVQPSQSLSITCTVSGFSLTNTGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1737 - protein, 119 aa, Artificial Sequence
  Description of Artificial Sequence: Synthetic heavy chain variable domain
QVQLKQSGPGLVQPSQSLSITCTVSGFSLTNVGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1738 - protein, 119 aa, Artificial Sequence
  Description of Artificial Sequence: Synthetic heavy chain variable domain
QVQLKQSGPGLVQPSQSLSITCTVSGFSLTNYEVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1739 - protein, 119 aa, Artificial Sequence
  Description of Artificial Sequence: Synthetic heavy chain variable domain
QVQLKQSGPGLVQPSQSLSITCTVSGFSLTNYGAHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1740 - protein, 119 aa, Artificial Sequence
  Description of Artificial Sequence: Synthetic heavy chain variable domain
QVQLKQSGPGLVQPSQSLSITCTVSGFSLTNYGCHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1741 - protein, 119 aa, Artificial Sequence
  Description of Artificial Sequence: Synthetic heavy chain variable domain
QVQLKQSGPGLVQPSQSLSITCTVSGFSLTNYGIHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1742 - protein, 119 aa, Artificial Sequence
  Description of Artificial Sequence: Synthetic heavy chain variable domain
QVQLKQSGPGLVQPSQSLSITCTVSGFSLTNYGLHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1743 - protein, 119 aa, Artificial Sequence
  Description of Artificial Sequence: Synthetic heavy chain variable domain
QVQLKQSGPGLVQPSQSLSITCTVSGFSLTNYGMHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1744 - protein, 119 aa, Artificial Sequence
  Description of Artificial Sequence: Synthetic heavy chain variable domain
QVQLKQSGPGLVQPSQSLSITCTVSGFSLTNYGPHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1745 - protein, 119 aa, Artificial Sequence
  Description of Artificial Sequence: Synthetic heavy chain variable domain
QVQLKQSGPGLVQPSQSLSITCTVSGFSLTNYGVHAVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1746 - protein, 119 aa, Artificial Sequence
  Description of Artificial Sequence: Synthetic heavy chain variable domain
QVQLKQSGPGLVQPSQSLSITCTVSGFSLTNYGVHIVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1747 - protein, 119 aa, Artificial Sequence
  Description of Artificial Sequence: Synthetic heavy chain variable domain
QVQLKQSGPGLVQPSQSLSITCTVSGFSLTNYGVHKVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1748 - protein, 119 aa, Artificial Sequence
  Description of Artificial Sequence: Synthetic heavy chain variable domain
QVQLKQSGPGLVQPSQSLSITCTVSGFSLTNYGVHVVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1749 - protein, 119 aa, Artificial Sequence
  Description of Artificial Sequence: Synthetic heavy chain variable domain
QVQLKQSGPGLVQPSQSLSITCTVSGFSLTNYGVHWIRQPPGKGLEWIGVIWSGGNTDYNTPFTSRLSINKDNSKSQVFFKMNSLQSNDTAIYYCARALTYYDYEFAYWGQGTLVTVSA

SEQ ID NO: 1750 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGAIWSGGNTDYNTPFTSRLSINKDNSKSQVFFKMNSLQSNDTAIYYCARALTYYDYEFAYWGQGTLVTVSA

SEQ ID NO: 1751 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGDIWSGGNTDYNTPFTSRLSINKDNSKSQVFFKMNSLQSNDTAIYYCARALTYYDYEFAYWGQGTLVTVSA

SEQ ID NO: 1752 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGEIWSGGNTDYNTPFTSRLSINKDNSKSQVFFKMNSLQSNDTAIYYCARALTYYDYEFAYWGQGTLVTVSA

SEQ ID NO: 1753 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGGIWSGGNTDYNTPFTSRLSINKDNSKSQVFFKMNSLQSNDTAIYYCARALTYYDYEFAYWGQGTLVTVSA

SEQ ID NO: 1754 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGHIWSGGNTDYNTPFTSRLSINKDNSKSQVFFKMNSLQSNDTAIYYCARALTYYDYEFAYWGQGTLVTVSA

SEQ ID NO: 1755 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGIIWSGGNTDYNTPFTSRLSINKDNSKSQVFFKMNSLQSNDTAIYYCARALTYYDYEFAYWGQGTLVTVSA

SEQ ID NO: 1756 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGKIWSGGNTDYNTPFTSRLSINKDNSKSQVFFKMNSLQSNDTAIYYCARALTYYDYEFAYWGQGTLVTVSA

SEQ ID NO: 1757 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGLIWSGGNTDYNTPFTSRLSINKDNSKSQVFFKMNSLQSNDTAIYYCARALTYYDYEFAYWGQGTLVTVSA

SEQ ID NO: 1758 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGNIWSGGNTDYNTPFTSRLSINKDNSKSQVFFKMNSLQSNDTAIYYCARALTYYDYEFAYWGQGTLVTVSA

SEQ ID NO: 1759 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGQIWSGGNTDYNTPFTSRLSINKDNSKSQVFFKMNSLQSNDTAIYYCARALTYYDYEFAYWGQGTLVTVSA

SEQ ID NO: 1760 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGTIWSGGNTDYNTPFTSRLSINKDNSKSQVFFKMNSLQSNDTAIYYCARALTYYDYEFAYWGQGTLVTVSA

SEQ ID NO: 1761 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVAWSGGNTDYNTPFTSRLSINKDNSKSQVFFKMNSLQSNDTAIYYCARALTYYDYEFAYWGQGTLVTVSA

SEQ ID NO: 1762 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVCWSGGNTDYNTPFTSRLSINKDNSKSQVFFKMNSLQSNDTAIYYCARALTYYDYEFAYWGQGTLVTVSA

SEQ ID NO: 1763 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVEWSGGNTDYNTPFTSRLSINKDNSKSQVFFKMNSLQSNDTAIYYCARALTYYDYEFAYWGQGTLVTVSA

SEQ ID NO: 1764 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVGWSGGNTDYNTPFTSRLSINKDNSKSQVFFKMNSLQSNDTAIYYCARALTYYDYEFAYWGQGTLVTVSA

SEQ ID NO: 1765 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVHWSGGNTDYNTPFTSRLSINKDNSKSQVFFKMNSLQSNDTAIYYCARALTYYDYEFAYWGQGTLVTVSA

SEQ ID NO: 1766 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIISGGNTDYNTPFTSRLSINKDNSKSQVFFKMNSLQSNDTAIYYCARALTYYDYEFAYWGQGTLVTVSA

SEQ ID NO: 1767 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVINSGGNTDYNTPFTSRLSINKDNSKSQVFFKMNSLQSNDTAIYYCARALTYYDYEFAYWGQGTLVTVSA

SEQ ID NO: 1768 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWAGGNTDYNTPFTSRLSINKDNSKSQVFFKMNSLQSNDTAIYYCARALTYYDYEFAYWGQGTLVTVSA

SEQ ID NO: 1769 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWCGGNTDYNTPFTSRLSINKDNSKSQVFFKMNSLQSNDTAIYYCARALTYYDYEFAYWGQGTLVTVSA

SEQ ID NO: 1770 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDDEFAYWGPGTLVTVSA

SEQ ID NO: 1771 - protein, 231 aa, Artificial Sequence
  Description of Artificial Sequence: Synthetic heavy chain variable domain
PKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1772 - protein, 104 aa, Artificial Sequence
  Description of Artificial Sequence: Synthetic heavy chain variable domain
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEC

SEQ ID NO: 1773 - protein, 119 aa, Artificial Sequence
  Description of Artificial Sequence: Synthetic heavy chain variable domain
QVQLKQSGPGLVQPSQSLSITCAVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1774 - protein, 119 aa, Artificial Sequence
  Description of Artificial Sequence: Synthetic heavy chain variable domain
QVQLKQSGPGLVQPSQSLSITCCVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1775 - protein, 119 aa, Artificial Sequence
  Description of Artificial Sequence: Synthetic heavy chain variable domain
QVQLKQSGPGLVQPSQSLSITCEVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1776 - protein, 119 aa, Artificial Sequence
  Description of Artificial Sequence: Synthetic heavy chain variable domain
QVQLKQSGPGLVQPSQSLSITCGVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1777 - protein, 119 aa, Artificial Sequence
  Description of Artificial Sequence: Synthetic heavy chain variable domain
QVQLKQSGPGLVQPSQSLSITCHVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1778 - protein, 119 aa, Artificial Sequence
  Description of Artificial Sequence: Synthetic heavy chain variable domain
QVQLKQSGPGLVQPSQSLSITCIVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1779 - protein, 119 aa, Artificial Sequence
  Description of Artificial Sequence: Synthetic heavy chain variable domain
QVQLKQSGPGLVQPSQSLSITCKVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1780 - protein, 119 aa, Artificial Sequence
  Description of Artificial Sequence: Synthetic heavy chain variable domain
QVQLKQSGPGLVQPSQSLSITCLVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1781 - protein, 119 aa, Artificial Sequence
  Description of Artificial Sequence: Synthetic heavy chain variable domain
QVQLKQSGPGLVQPSQSLSITCMVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1782 - protein, 119 aa, Artificial Sequence
  Description of Artificial Sequence: Synthetic heavy chain variable domain
QVQLKQSGPGLVQPSQSLSITCNVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1783 - protein, 119 aa, Artificial Sequence
  Description of Artificial Sequence: Synthetic heavy chain variable domain
QVQLKQSGPGLVQPSQSLSITCPVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1784 - protein, 119 aa, Artificial Sequence
  Description of Artificial Sequence: Synthetic heavy chain variable domain
QVQLKQSGPGLVQPSQSLSITCRVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1785 - protein, 119 aa, Artificial Sequence
  Description of Artificial Sequence: Synthetic heavy chain variable domain
QVQLKQSGPGLVQPSQSLSITCSVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1786 - protein, 119 aa, Artificial Sequence
  Description of Artificial Sequence: Synthetic heavy chain variable domain
QVQLKQSGPGLVQPSQSLSITCTASGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1787 - protein, 119 aa, Artificial Sequence
  Description of Artificial Sequence: Synthetic heavy chain variable domain
QVQLKQSGPGLVQPSQSLSITCTESGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1788 - protein, 119 aa, Artificial Sequence
  Description of Artificial Sequence: Synthetic heavy chain variable domain
QVQLKQSGPGLVQPSQSLSITCTESGRSLTNYGVHWVRQSPGKGLEWLGVIWSGGNTDYNTPFTSRLSINKDNSKSQVFFKMNSLQSNDTAIYYCAHALTYYDYEFAYWGPGTLVTVSA

SEQ ID NO: 1789 - protein, 119 aa, Artificial Sequence
  Description of Artificial Sequence: Synthetic heavy chain variable domain
QVQLKQSGPGLVQPSQSLSITCTFSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1790 - protein, 119 aa, Artificial Sequence
  Description of Artificial Sequence: Synthetic heavy chain variable domain
QVQLKQSGPGLVQPSQSLSITCTGSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1791 - protein, 119 aa, Artificial Sequence
  Description of Artificial Sequence: Synthetic heavy chain variable domain
QVQLKQSGPGLVQPSQSLSITCTISGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1792 - protein, 119 aa, Artificial Sequence
  Description of Artificial Sequence: Synthetic heavy chain variable domain
QVQLKQSGPGLVQPSQSLSITCTLSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1793 - protein, 119 aa, Artificial Sequence
  Description of Artificial Sequence: Synthetic heavy chain variable domain
QVQLKQSGPGLVQPSQSLSITCTMSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1794 - protein, 119 aa, Artificial Sequence
  Description of Artificial Sequence: Synthetic heavy chain variable domain
QVQLKQSGPGLVQPSQSLSITCTPSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1795 - protein, 119 aa, Artificial Sequence
  Description of Artificial Sequence: Synthetic heavy chain variable domain
QVQLKQSGPGLVQPSQSLSITCTRSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1796 - protein, 119 aa, Artificial Sequence
  Description of Artificial Sequence: Synthetic heavy chain variable domain
QVQLKQSGPGLVQPSQSLSITCTSSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1797 - protein, 119 aa, Artificial Sequence
  Description of Artificial Sequence: Synthetic heavy chain variable domain
QVQLKQSGPGLVQPSQSLSITCTTSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1798 - protein, 119 aa, Artificial Sequence
  Description of Artificial Sequence: Synthetic heavy chain variable domain
QVQLKQSGPGLVQPSQSLSITCTVAGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1799 - protein, 119 aa, Artificial Sequence
  Description of Artificial Sequence: Synthetic heavy chain variable domain
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDDEFAYWGQGTLVTVSA

SEQ ID NO: 1800 - protein, 119 aa, Artificial Sequence
  Description of Artificial Sequence: Synthetic heavy chain variable domain
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDYEFAYWGPGTLVTVSA

SEQ ID NO: 1801 - protein, 119 aa, Artificial Sequence
  Description of Artificial Sequence: Synthetic heavy chain variable domain
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1802 - protein, 119 aa, Artificial Sequence
  Description of Artificial Sequence: Synthetic heavy chain variable domain
QVQLKQSGPGLVQPSQSLSITCTVDGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1803 - protein, 119 aa, Artificial Sequence
  Description of Artificial Sequence: Synthetic heavy chain variable domain
QVQLKQSGPGLVQPSQSLSITCTVEGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1804 - protein, 119 aa, Artificial Sequence
  Description of Artificial Sequence: Synthetic heavy chain variable domain
QVQLKQSGPGLVQPSQSLSITCTVFGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1805 - protein, 119 aa, Artificial Sequence
  Description of Artificial Sequence: Synthetic heavy chain variable domain
QVQLKQSGPGLVQPSQSLSITCTVGGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1806 - protein, 119 aa, Artificial Sequence
  Description of Artificial Sequence: Synthetic heavy chain variable domain
QVQLKQSGPGLVQPSQSLSITCTVHGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1807 - protein, 119 aa, Artificial Sequence
  Description of Artificial Sequence: Synthetic heavy chain variable domain
QVQLKQSGPGLVQPSQSLSITCTVIGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1808 - protein, 119 aa, Artificial Sequence
  Description of Artificial Sequence: Synthetic heavy chain variable domain
QVQLKQSGPGLVQPSQSLSITCTVLGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1809 - protein, 119 aa, Artificial Sequence
  Description of Artificial Sequence: Synthetic heavy chain variable domain
QVQLKQSGPGLVQPSQSLSITCTVMGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1810 - protein, 119 aa, Artificial Sequence
  Description of Artificial Sequence: Synthetic heavy chain variable domain
QVQLKQSGPGLVQPSQSLSITCTVPGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1811 - protein, 119 aa, Artificial Sequence
  Description of Artificial Sequence: Synthetic heavy chain variable domain
QVQLKQSGPGLVQPSQSLSITCTVQGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1812 - protein, 119 aa, Artificial Sequence
  Description of Artificial Sequence: Synthetic heavy chain variable domain
QVQLKQSGPGLVQPSQSLSITCTVRGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1813 - protein, 119 aa, Artificial Sequence
  Description of Artificial Sequence: Synthetic heavy chain variable domain
QVQLKQSGPGLVQPSQSLSITCTVSDFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1814 - protein, 119 aa, Artificial Sequence
  Description of Artificial Sequence: Synthetic heavy chain variable domain
QVQLKQSGPGLVQPSQSLSITCTVSFFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1815 - protein, 119 aa, Artificial Sequence
  Description of Artificial Sequence: Synthetic heavy chain variable domain
QVQLKQSGPGLVQPSQSLSITCTVSGASLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1816 - protein, 119 aa, Artificial Sequence
  Description of Artificial Sequence: Synthetic heavy chain variable domain
QVQLKQSGPGLVQPSQSLSITCTVSGDSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1817 - protein, 119 aa, Artificial Sequence
  Description of Artificial Sequence: Synthetic heavy chain variable domain
QVQLKQSGPGLVQPSQSLSITCTVSGESLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1818 - protein, 119 aa, Artificial Sequence
  Description of Artificial Sequence: Synthetic heavy chain variable domain
QVQLKQSGPGLVQPSQSLSITCTVSGFALTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1819 - protein, 119 aa, Artificial Sequence
  Description of Artificial Sequence: Synthetic heavy chain variable domain
QVQLKQSGPGLVQPSQSLSITCTVSGFCLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1820 - protein, 119 aa, Artificial Sequence
  Description of Artificial Sequence: Synthetic heavy chain variable domain
QVQLKQSGPGLVQPSQSLSITCTVSGFDLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1821 - protein, 119 aa, Artificial Sequence
  Description of Artificial Sequence: Synthetic heavy chain variable domain
QVQLKQSGPGLVQPSQSLSITCTVSGFHLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1822 - protein, 119 aa, Artificial Sequence
  Description of Artificial Sequence: Synthetic heavy chain variable domain
QVQLKQSGPGLVQPSQSLSITCTVSGFILTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1823 - protein, 119 aa, Artificial Sequence
  Description of Artificial Sequence: Synthetic heavy chain variable domain
QVQLKQSGPGLVQPSQSLSITCTVSGFKLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1824 - protein, 119 aa, Artificial Sequence
  Description of Artificial Sequence: Synthetic heavy chain variable domain
QVQLKQSGPGLVQPSQSLSITCTVSGFLLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1825 - protein, 119 aa, Artificial Sequence
  Description of Artificial Sequence: Synthetic heavy chain variable domain
QVQLKQSGPGLVQPSQSLSITCTVSGFMLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1826 - protein, 119 aa, Artificial Sequence
  Description of Artificial Sequence: Synthetic heavy chain variable domain
QVQLKQSGPGLVQPSQSLSITCTVSGFPLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1827 - protein, 119 aa, Artificial Sequence
  Description of Artificial Sequence: Synthetic heavy chain variable domain
QVQLKQSGPGLVQPSQSLSITCTVSGFQLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1828 - protein, 119 aa, Artificial Sequence
  Description of Artificial Sequence: Synthetic heavy chain variable domain
QVQLKQSGPGLVQPSQSLSITCTVSGFRLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1829 - protein, 119 aa, Artificial Sequence
  Description of Artificial Sequence: Synthetic heavy chain variable domain
QVQLKQSGPGLVQPSQSLSITCTVSGFSATNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1830 - protein, 119 aa, Artificial Sequence
  Description of Artificial Sequence: Synthetic heavy chain variable domain
QVQLKQSGPGLVQPSQSLSITCTVSGFSDTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1831 - protein, 119 aa, Artificial Sequence
  Description of Artificial Sequence: Synthetic heavy chain variable domain
QVQLKQSGPGLVQPSQSLSITCTVSGFSGTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1832 - protein, 119 aa, Artificial Sequence
  Description of Artificial Sequence: Synthetic heavy chain variable domain
QVQLKQSGPGLVQPSQSLSITCTVSGFSHTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1833 - protein, 119 aa, Artificial Sequence
  Description of Artificial Sequence: Synthetic heavy chain variable domain
QVQLKQSGPGLVQPSQSLSITCTVSGFSITNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1834 - protein, 119 aa, Artificial Sequence
  Description of Artificial Sequence: Synthetic heavy chain variable domain
QVQLKQSGPGLVQPSQSLSITCTVSGFSKTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1835 - protein, 119 aa, Artificial Sequence
  Description of Artificial Sequence: Synthetic heavy chain variable domain
QVQLKQSGPGLVQPSQSLSITCTVSGFSLDNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1836 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDDEFAYWGPGTLVTVSA

SEQ ID NO: 1837 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDDEFAYWGQGTLVTVSA

SEQ ID NO: 1838 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDFEFAYWGQGTLVTVSA

SEQ ID NO: 1839 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDHEFAYWGQGTLVTVSA

SEQ ID NO: 1840 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDIEFAYWGQGTLVTVSA

SEQ ID NO: 1841 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDLEFAYWGQGTLVTVSA

SEQ ID NO: 1842 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDMEFAYWGQGTLVTVSA

SEQ ID NO: 1843 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDSEFAYWGQGTLVTVSA

SEQ ID NO: 1844 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDVEFAYWGQGTLVTVSA

SEQ ID NO: 1845 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFACWGQGTLVTVSA

SEQ ID NO: 1846 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAFWGQGTLVTVSA

SEQ ID NO: 1847 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAHWGQGTLVTVSA

SEQ ID NO: 1848 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAIWGQGTLVTVSA

SEQ ID NO: 1849 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAKWGQGTLVTVSA

SEQ ID NO: 1850 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFALWGQGTLVTVSA

SEQ ID NO: 1851 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFANWGQGTLVTVSA

SEQ ID NO: 1852 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFARWGQGTLVTVSA

SEQ ID NO: 1853 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFASWGQGTLVTVSA

SEQ ID NO: 1854 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFATWGQGTLVTVSA

SEQ ID NO: 1855 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAVWGQGTLVTVSA

SEQ ID NO: 1856 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAWWGQGTLVTVSA

SEQ ID NO: 1857 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYIGQGTLVTVSA

SEQ ID NO: 1858 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYMGQGTLVTVSA

SEQ ID NO: 1859 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWAQGTLVTVSA

SEQ ID NO: 1860 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGDGTLVTVSA

SEQ ID NO: 1861 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGEGTLVTVSA

SEQ ID NO: 1862 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGGGTLVTVSA

SEQ ID NO: 1863 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGHGTLVTVSA

SEQ ID NO: 1864 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGIGTLVTVSA

SEQ ID NO: 1865 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGKGTLVTVSA

SEQ ID NO: 1866 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGLGTLVTVSA

SEQ ID NO: 1867 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGMGTLVTVSA

SEQ ID NO: 1868 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGPGTLVTVSA

SEQ ID NO: 1869 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQATLVTVSA

SEQ ID NO: 1870 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQNTLVTVSA

SEQ ID NO: 1871 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQPTLVTVSA

SEQ ID NO: 1872 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQSTLVTVSA

SEQ ID NO: 1873 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQTTLVTVSA

SEQ ID NO: 1874 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQYTLVTVSA

SEQ ID NO: 1875 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGRGTLVTVSA

SEQ ID NO: 1876 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGSGTLVTVSA

SEQ ID NO: 1877 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGTGTLVTVSA

SEQ ID NO: 1878 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGVGTLVTVSA

SEQ ID NO: 1879 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGWGTLVTVSA

SEQ ID NO: 1880 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGYGTLVTVSA

SEQ ID NO: 1881 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWMQGTLVTVSA

SEQ ID NO: 1882 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWPQGTLVTVSA

SEQ ID NO: 1883 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWRQGTLVTVSA

SEQ ID NO: 1884 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWTQGTLVTVSA

SEQ ID NO: 1885 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYYGQGTLVTVSA

SEQ ID NO: 1886 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFCYWGQGTLVTVSA

SEQ ID NO: 1887 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFDYWGQGTLVTVSA

SEQ ID NO: 1888 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFEYWGQGTLVTVSA

SEQ ID NO: 1889 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFGYWGQGTLVTVSA

SEQ ID NO: 1890 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFHYWGQGTLVTVSA

SEQ ID NO: 1891 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFKYWGQGTLVTVSA

SEQ ID NO: 1892 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFLYWGQGTLVTVSA

SEQ ID NO: 1893 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFNYWGQGTLVTVSA

SEQ ID NO: 1894 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFRYWGQGTLVTVSA

SEQ ID NO: 1895 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFSYWGQGTLVTVSA

SEQ ID NO: 1896 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFTYWGQGTLVTVSA

SEQ ID NO: 1897 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFYYWGQGTLVTVSA

SEQ ID NO: 1898 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYELAYWGQGTLVTVSA

SEQ ID NO: 1899 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEVAYWGQGTLVTVSA

SEQ ID NO: 1900 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEWAYWGQGTLVTVSA

SEQ ID NO: 1901 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEYAYWGQGTLVTVSA

SEQ ID NO: 1902 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYHFAYWGQGTLVTVSA

SEQ ID NO: 1903 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYTFAYWGQGTLVTVSA

SEQ ID NO: 1904 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYIYEFAYWGQGTLVTVSA

SEQ ID NO: 1905 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYLYEFAYWGQGTLVTVSA

SEQ ID NO: 1906 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYPYEFAYWGQGTLVTVSA

SEQ ID NO: 1907 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYQYEFAYWGQGTLVTVSA

SEQ ID NO: 1908 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYRYEFAYWGQGTLVTVSA

SEQ ID NO: 1909 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYYYEFAYWGQGTLVTVSA

SEQ ID NO: 1910 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALVYYDYEFAYWGQGTLVTVSA

SEQ ID NO: 1911 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALYYYDYEFAYWGQGTLVTVSA

SEQ ID NO: 1912 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARANTYYDYEFAYWGQGTLVTVSA

SEQ ID NO: 1913 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARAWTYYDYEFAYWGQGTLVTVSA

SEQ ID NO: 1914 - protein, 117 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARPLTYYDYEFAYWGQGTLVTV

SEQ ID NO: 1915 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCAWALTYYDYEFAYWGQGTLVTVSA

SEQ ID NO: 1916 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSRVFFKMNSLQSNDTAIYYCARALTYYDYEFAYWGQGTLVTVSA

SEQ ID NO: 1917 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSSVFFKMNSLQSNDTAIYYCARALTYYDYEFAYWGQGTLVTVSA

SEQ ID NO: 1918 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSVVFFKMNSLQSNDTAIYYCARALTYYDYEFAYWGQGTLVTVSA

SEQ ID NO: 1919 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSWVFFKMNSLQSNDTAIYYCARALTYYDYEFAYWGQGTLVTVSA

SEQ ID NO: 1920 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSYVFFKMNSLQSNDTAIYYCARALTYYDYEFAYWGQGTLVTVSA

SEQ ID NO: 1921 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKTQVFFKMNSLQSNDTAIYYCARALTYYDYEFAYWGQGTLVTVSA

SEQ ID NO: 1922 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKVQVFFKMNSLQSNDTAIYYCARALTYYDYEFAYWGQGTLVTVSA

SEQ ID NO: 1923 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKYQVFFKMNSLQSNDTAIYYCARALTYYDYEFAYWGQGTLVTVSA

SEQ ID NO: 1924 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSLSQVFFKMNSLQSNDTAIYYCARALTYYDYEFAYWGQGTLVTVSA

SEQ ID NO: 1925 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSMSQVFFKMNSLQSNDTAIYYCARALTYYDYEFAYWGQGTLVTVSA

SEQ ID NO: 1926 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSPSQVFFKMNSLQSNDTAIYYCARALTYYDYEFAYWGQGTLVTVSA

SEQ ID NO: 1927 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSQSQVFFKMNSLQSNDTAIYYCARALTYYDYEFAYWGQGTLVTVSA

SEQ ID NO: 1928 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSRSQVFFKMNSLQSNDTAIYYCARALTYYDYEFAYWGQGTLVTVSA

SEQ ID NO: 1929 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSTSQVFFKMNSLQSNDTAIYYCARALTYYDYEFAYWGQGTLVTVSA

SEQ ID NO: 1930 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSVSQVFFKMNSLQSNDTAIYYCARALTYYDYEFAYWGQGTLVTVSA

SEQ ID NO: 1931 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSWSQVFFKMNSLQSNDTAIYYCARALTYYDYEFAYWGQGTLVTVSA

SEQ ID NO: 1932 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSYSQVFFKMNSLQSNDTAIYYCARALTYYDYEFAYWGQGTLVTVSA

SEQ ID NO: 1933 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNTKSQVFFKMNSLQSNDTAIYYCARALTYYDYEFAYWGQGTLVTVSA

SEQ ID NO: 1934 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNVKSQVFFKMNSLQSNDTAIYYCARALTYYDYEFAYWGQGTLVTVSA

SEQ ID NO: 1935 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNYKSQVFFKMNSLQSNDTAIYYCARALTYYDYEFAYWGQGTLVTVSA

SEQ ID NO: 1936 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDPSKSQVFFKMNSLQSNDTAIYYCARALTYYDYEFAYWGQGTLVTVSA

SEQ ID NO: 1937 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDQSKSQVFFKMNSLQSNDTAIYYCARALTYYDYEFAYWGQGTLVTVSA

SEQ ID NO: 1938 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDRSKSQVFFKMNSLQSNDTAIYYCARALTYYDYEFAYWGQGTLVTVSA

SEQ ID NO: 1939 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDSSKSQVFFKMNSLQSNDTAIYYCARALTYYDYEFAYWGQGTLVTVSA

SEQ ID NO: 1940 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDTSKSQVFFKMNSLQSNDTAIYYCARALTYYDYEFAYWGQGTLVTVSA

SEQ ID NO: 1941 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDVSKSQVFFKMNSLQSNDTAIYYCARALTYYDYEFAYWGQGTLVTVSA

SEQ ID NO: 1942 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDWSKSQVFFKMNSLQSNDTAIYYCARALTYYDYEFAYWGQGTLVTVSA

SEQ ID NO: 1943 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDYSKSQVFFKMNSLQSNDTAIYYCARALTYYDYEFAYWGQGTLVTVSA

SEQ ID NO: 1944 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKGNSKSQVFFKMNSLQSNDTAIYYCARALTYYDYEFAYWGQGTLVTVSA

SEQ ID NO: 1945 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKHNSKSQVFFKMNSLQSNDTAIYYCARALTYYDYEFAYWGQGTLVTVSA

SEQ ID NO: 1946 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKINSKSQVFFKMNSLQSNDTAIYYCARALTYYDYEFAYWGQGTLVTVSA

SEQ ID NO: 1947 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKKNSKSQVFFKMNSLQSNDTAIYYCARALTYYDYEFAYWGQGTLVTVSA

SEQ ID NO: 1948 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDDEFAYWGPGTLVTVSA

SEQ ID NO: 1949 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDYEFAYWGQGTLVTVSA

SEQ ID NO: 1950 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKMNSKSQVFFKMNSLQSNDTAIYYCARALTYYDYEFAYWGQGTLVTVSA

SEQ ID NO: 1951 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKNNSKSQVFFKMNSLQSNDTAIYYCARALTYYDYEFAYWGQGTLVTVSA

SEQ ID NO: 1952 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKPNSKSQVFFKMNSLQSNDTAIYYCARALTYYDYEFAYWGQGTLVTVSA

SEQ ID NO: 1953 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKQNSKSQVFFKMNSLQSNDTAIYYCARALTYYDYEFAYWGQGTLVTVSA

SEQ ID NO: 1954 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKRNSKSQVFFKMNSLQSNDTAIYYCARALTYYDYEFAYWGQGTLVTVSA

SEQ ID NO: 1955 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKSNSKSQVFFKMNSLQSNDTAIYYCARALTYYDYEFAYWGQGTLVTVSA

SEQ ID NO: 1956 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKVNSKSQVFFKMNSLQSNDTAIYYCARALTYYDYEFAYWGQGTLVTVSA

SEQ ID NO: 1957 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKWNSKSQVFFKMNSLQSNDTAIYYCARALTYYDYEFAYWGQGTLVTVSA

SEQ ID NO: 1958 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKYNSKSQVFFKMNSLQSNDTAIYYCARALTYYDYEFAYWGQGTLVTVSA

SEQ ID NO: 1959 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINLDNSKSQVFFKMNSLQSNDTAIYYCARALTYYDYEFAYWGQGTLVTVSA

SEQ ID NO: 1960 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINQDNSKSQVFFKMNSLQSNDTAIYYCARALTYYDYEFAYWGQGTLVTVSA

SEQ ID NO: 1961 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINRDNSKSQVFFKMNSLQSNDTAIYYCARALTYYDYEFAYWGQGTLVTVSA

SEQ ID NO: 1962 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINSDNSKSQVFFKMNSLQSNDTAIYYCARALTYYDYEFAYWGQGTLVTVSA

SEQ ID NO: 1963 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINTDNSKSQVFFKMNSLQSNDTAIYYCARALTYYDYEFAYWGQGTLVTVSA

SEQ ID NO: 1964 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINVDNSKSQVFFKMNSLQSNDTAIYYCARALTYYDYEFAYWGQGTLVTVSA

SEQ ID NO: 1965 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINWDNSKSQVFFKMNSLQSNDTAIYYCARALTYYDYEFAYWGQGTLVTVSA

SEQ ID NO: 1966 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINYDNSKSQVFFKMNSLQSNDTAIYYCARALTYYDYEFAYWGQGTLVTVSA

SEQ ID NO: 1967 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSIPKDNSKSQVFFKMNSLQSNDTAIYYCARALTYYDYEFAYWGQGTLVTVSA

SEQ ID NO: 1968 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSIQKDNSKSQVFFKMNSLQSNDTAIYYCARALTYYDYEFAYWGQGTLVTVSA

SEQ ID NO: 1969 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSIRKDNSKSQVFFKMNSLQSNDTAIYYCARALTYYDYEFAYWGQGTLVTVSA

SEQ ID NO: 1970 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSISKDNSKSQVFFKMNSLQSNDTAIYYCARALTYYDYEFAYWGQGTLVTVSA

SEQ ID NO: 1971 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSITKDNSKSQVFFKMNSLQSNDTAIYYCARALTYYDYEFAYWGQGTLVTVSA

SEQ ID NO: 1972 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSIVKDNSKSQVFFKMNSLQSNDTAIYYCARALTYYDYEFAYWGQGTLVTVSA

SEQ ID NO: 1973 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSIYKDNSKSQVFFKMNSLQSNDTAIYYCARALTYYDYEFAYWGQGTLVTVSA

SEQ ID NO: 1974 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSYNKDNSKSQVFFKMNSLQSNDTAIYYCARALTYYDYEFAYWGQGTLVTVSA

SEQ ID NO: 1975 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLVINKDNSKSQVFFKMNSLQSNDTAIYYCARALTYYDYEFAYWGQGTLVTVSA

SEQ ID NO: 1976 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRMSINKDNSKSQVFFKMNSLQSNDTAIYYCARALTYYDYEFAYWGQGTLVTVSA

SEQ ID NO: 1977 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRQSINKDNSKSQVFFKMNSLQSNDTAIYYCARALTYYDYEFAYWGQGTLVTVSA

SEQ ID NO: 1978 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRSSINKDNSKSQVFFKMNSLQSNDTAIYYCARALTYYDYEFAYWGQGTLVTVSA

SEQ ID NO: 1979 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRTSINKDNSKSQVFFKMNSLQSNDTAIYYCARALTYYDYEFAYWGQGTLVTVSA

SEQ ID NO: 1980 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRVSINKDNSKSQVFFKMNSLQSNDTAIYYCARALTYYDYEFAYWGQGTLVTVSA

SEQ ID NO: 1981 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRYSINKDNSKSQVFFKMNSLQSNDTAIYYCARALTYYDYEFAYWGQGTLVTVSA

SEQ ID NO: 1982 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSSLSINKDNSKSQVFFKMNSLQSNDTAIYYCARALTYYDYEFAYWGQGTLVTVSA

SEQ ID NO: 1983 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSTLSINKDNSKSQVFFKMNSLQSNDTAIYYCARALTYYDYEFAYWGQGTLVTVSA

SEQ ID NO: 1984 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSVLSINKDNSKSQVFFKMNSLQSNDTAIYYCARALTYYDYEFAYWGQGTLVTVSA

SEQ ID NO: 1985 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTTRLSINKDNSKSQVFFKMNSLQSNDTAIYYCARALTYYDYEFAYWGQGTLVTVSA

SEQ ID NO: 1986 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTWRLSINKDNSKSQVFFKMNSLQSNDTAIYYCARALTYYDYEFAYWGQGTLVTVSA

SEQ ID NO: 1987 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTYRLSINKDNSKSQVFFKMNSLQSNDTAIYYCARALTYYDYEFAYWGQGTLVTVSA

SEQ ID NO: 1988 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFVSRLSINKDNSKSQVFFKMNSLQSNDTAIYYCARALTYYDYEFAYWGQGTLVTVSA

SEQ ID NO: 1989 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPGTSRLSINKDNSKSQVFFKMNSLQSNDTAIYYCARALTYYDYEFAYWGQGTLVTVSA

SEQ ID NO: 1990 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPHTSRLSINKDNSKSQVFFKMNSLQSNDTAIYYCARALTYYDYEFAYWGQGTLVTVSA

SEQ ID NO: 1991 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPLTSRLSINKDNSKSQVFFKMNSLQSNDTAIYYCARALTYYDYEFAYWGQGTLVTVSA

SEQ ID NO: 1992 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPMTSRLSINKDNSKSQVFFKMNSLQSNDTAIYYCARALTYYDYEFAYWGQGTLVTVSA

SEQ ID NO: 1993 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPNTSRLSINKDNSKSQVFFKMNSLQSNDTAIYYCARALTYYDYEFAYWGQGTLVTVSA

SEQ ID NO: 1994 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPPTSRLSINKDNSKSQVFFKMNSLQSNDTAIYYCARALTYYDYEFAYWGQGTLVTVSA

SEQ ID NO: 1995 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPQTSRLSINKDNSKSQVFFKMNSLQSNDTAIYYCARALTYYDYEFAYWGQGTLVTVSA

SEQ ID NO: 1996 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPRTSRLSINKDNSKSQVFFKMNSLQSNDTAIYYCARALTYYDYEFAYWGQGTLVTVSA

SEQ ID NO: 1997 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPSTSRLSINKDNSKSQVFFKMNSLQSNDTAIYYCARALTYYDYEFAYWGQGTLVTVSA

SEQ ID NO: 1998 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPVTSRLSINKDNSKSQVFFKMNSLQSNDTAIYYCARALTYYDYEFAYWGQGTLVTVSA

SEQ ID NO: 1999 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYPTPFTSRLSINKDNSKSQVFFKMNSLQSNDTAIYYCARALTYYDYEFAYWGQGTLVTVSA

SEQ ID NO: 2000 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYQTPFTSRLSINKDNSKSQVFFKMNSLQSNDTAIYYCARALTYYDYEFAYWGQGTLVTVSA

SEQ ID NO: 2001 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYSTPFTSRLSINKDNSKSQVFFKMNSLQSNDTAIYYCARALTYYDYEFAYWGQGTLVTVSA

SEQ ID NO: 2002 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYTTPFTSRLSINKDNSKSQVFFKMNSLQSNDTAIYYCARALTYYDYEFAYWGQGTLVTVSA

SEQ ID NO: 2003 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYYTPFTSRLSINKDNSKSQVFFKMNSLQSNDTAIYYCARALTYYDYEFAYWGQGTLVTVSA

SEQ ID NO: 2004 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTGYNTPFTSRLSINKDNSKSQVFFKMNSLQSNDTAIYYCARALTYYDYEFAYWGQGTLVTVSA

SEQ ID NO: 2005 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTLYNTPFTSRLSINKDNSKSQVFFKMNSLQSNDTAIYYCARALTYYDYEFAYWGQGTLVTVSA

SEQ ID NO: 2006 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTMYNTPFTSRLSINKDNSKSQVFFKMNSLQSNDTAIYYCARALTYYDYEFAYWGQGTLVTVSA

SEQ ID NO: 2007 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTNYNTPFTSRLSINKDNSKSQVFFKMNSLQSNDTAIYYCARALTYYDYEFAYWGQGTLVTVSA

SEQ ID NO: 2008 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTQYNTPFTSRLSINKDNSKSQVFFKMNSLQSNDTAIYYCARALTYYDYEFAYWGQGTLVTVSA

SEQ ID NO: 2009 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNWDYNTPFTSRLSINKDNSKSQVFFKMNSLQSNDTAIYYCARALTYYDYEFAYWGQGTLVTVSA

SEQ ID NO: 2010 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNYDYNTPFTSRLSINKDNSKSQVFFKMNSLQSNDTAIYYCARALTYYDYEFAYWGQGTLVTVSA

SEQ ID NO: 2011 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGPTDYNTPFTSRLSINKDNSKSQVFFKMNSLQSNDTAIYYCARALTYYDYEFAYWGQGTLVTVSA

SEQ ID NO: 2012 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGSTDYNTPFTSRLSINKDNSKSQVFFKMNSLQSNDTAIYYCARALTYYDYEFAYWGQGTLVTVSA

SEQ ID NO: 2013 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGVTDYNTPFTSRLSINKDNSKSQVFFKMNSLQSNDTAIYYCARALTYYDYEFAYWGQGTLVTVSA

SEQ ID NO: 2014 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGHNTDYNTPFTSRLSINKDNSKSQVFFKMNSLQSNDTAIYYCARALTYYDYEFAYWGQGTLVTVSA

SEQ ID NO: 2015 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGMNTDYNTPFTSRLSINKDNSKSQVFFKMNSLQSNDTAIYYCARALTYYDYEFAYWGQGTLVTVSA

SEQ ID NO: 2016 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGRNTDYNTPFTSRLSINKDNSKSQVFFKMNSLQSNDTAIYYCARALTYYDYEFAYWGQGTLVTVSA

SEQ ID NO: 2017 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGSNTDYNTPFTSRLSINKDNSKSQVFFKMNSLQSNDTAIYYCARALTYYDYEFAYWGQGTLVTVSA

SEQ ID NO: 2018 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGYNTDYNTPFTSRLSINKDNSKSQVFFKMNSLQSNDTAIYYCARALTYYDYEFAYWGQGTLVTVSA

SEQ ID NO: 2019 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSHGNTDYNTPFTSRLSINKDNSKSQVFFKMNSLQSNDTAIYYCARALTYYDYEFAYWGQGTLVTVSA

SEQ ID NO: 2020 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSPGNTDYNTPFTSRLSINKDNSKSQVFFKMNSLQSNDTAIYYCARALTYYDYEFAYWGQGTLVTVSA

SEQ ID NO: 2021 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSRGNTDYNTPFTSRLSINKDNSKSQVFFKMNSLQSNDTAIYYCARALTYYDYEFAYWGQGTLVTVSA

SEQ ID NO: 2022 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSSGNTDYNTPFTSRLSINKDNSKSQVFFKMNSLQSNDTAIYYCARALTYYDYEFAYWGQGTLVTVSA

SEQ ID NO: 2023 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWTGGNTDYNTPFTSRLSINKDNSKSQVFFKMNSLQSNDTAIYYCARALTYYDYEFAYWGQGTLVTVSA

SEQ ID NO: 2024 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWVGGNTDYNTPFTSRLSINKDNSKSQVFFKMNSLQSNDTAIYYCARALTYYDYEFAYWGQGTLVTVSA

SEQ ID NO: 2025 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWYGGNTDYNTPFTSRLSINKDNSKSQVFFKMNSLQSNDTAIYYCARALTYYDYEFAYWGQGTLVTVSA

SEQ ID NO: 2026 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIYSGGNTDYNTPFTSRLSINKDNSKSQVFFKMNSLQSNDTAIYYCARALTYYDYEFAYWGQGTLVTVSA

SEQ ID NO: 2027 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVKWSGGNTDYNTPFTSRLSINKDNSKSQVFFKMNSLQSNDTAIYYCARALTYYDYEFAYWGQGTLVTVSA

SEQ ID NO: 2028 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVLWSGGNTDYNTPFTSRLSINKDNSKSQVFFKMNSLQSNDTAIYYCARALTYYDYEFAYWGQGTLVTVSA

SEQ ID NO: 2029 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVNWSGGNTDYNTPFTSRLSINKDNSKSQVFFKMNSLQSNDTAIYYCARALTYYDYEFAYWGQGTLVTVSA

SEQ ID NO: 2030 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVQWSGGNTDYNTPFTSRLSINKDNSKSQVFFKMNSLQSNDTAIYYCARALTYYDYEFAYWGQGTLVTVSA

SEQ ID NO: 2031 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVSWSGGNTDYNTPFTSRLSINKDNSKSQVFFKMNSLQSNDTAIYYCARALTYYDYEFAYWGQGTLVTVSA

SEQ ID NO: 2032 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVVWSGGNTDYNTPFTSRLSINKDNSKSQVFFKMNSLQSNDTAIYYCARALTYYDYEFAYWGQGTLVTVSA

SEQ ID NO: 2033 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVYWSGGNTDYNTPFTSRLSINKDNSKSQVFFKMNSLQSNDTAIYYCARALTYYDYEFAYWGQGTLVTVSA

SEQ ID NO: 2034 - protein, 119 aa, Artificial Sequence
  Description of Artificial Sequence: Synthetic heavy chain variable domain
QVQLKQSGPGLVQPSQSLSITCTVSGFSLTNYGVHYVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2035 - protein, 119 aa, Artificial Sequence
  Description of Artificial Sequence: Synthetic heavy chain variable domain
QVQLKQSGPGLVQPSQSLSITCTVSGFSLTNYGVIWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2036 - protein, 119 aa, Artificial Sequence
  Description of Artificial Sequence: Synthetic heavy chain variable domain
QVQLKQSGPGLVQPSQSLSITCTVSGFSLTNYGVQWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2037 - protein, 119 aa, Artificial Sequence
  Description of Artificial Sequence: Synthetic heavy chain variable domain
QVQLKQSGPGLVQPSQSLSITCTVSGFSLTNYMVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2038 - protein, 119 aa, Artificial Sequence
  Description of Artificial Sequence: Synthetic heavy chain variable domain
QVQLKQSGPGLVQPSQSLSITCTVSGFSLTNYSVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2039 - protein, 119 aa, Artificial Sequence
  Description of Artificial Sequence: Synthetic heavy chain variable domain
QVQLKQSGPGLVQPSQSLSITCTVSGFSLTNYTVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2040 - protein, 119 aa, Artificial Sequence
  Description of Artificial Sequence: Synthetic heavy chain variable domain
QVQLKQSGPGLVQPSQSLSITCTVSGFSLTNYYVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2041 - protein, 119 aa, Artificial Sequence
  Description of Artificial Sequence: Synthetic heavy chain variable domain
QVQLKQSGPGLVQPSQSLSITCTVSGFSLTTYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2042 - protein, 119 aa, Artificial Sequence
  Description of Artificial Sequence: Synthetic heavy chain variable domain
QVQLKQSGPGLVQPSQSLSITCTVSGFSLTVYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2043 - protein, 119 aa, Artificial Sequence
  Description of Artificial Sequence: Synthetic heavy chain variable domain
QVQLKQSGPGLVQPSQSLSITCTVSGFSLVNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2044 - protein, 119 aa, Artificial Sequence
  Description of Artificial Sequence: Synthetic heavy chain variable domain
QVQLKQSGPGLVQPSQSLSITCTVSGFSLWNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2045 - protein, 119 aa, Artificial Sequence
  Description of Artificial Sequence: Synthetic heavy chain variable domain
QVQLKQSGPGLVQPSQSLSITCTVSGFSLYNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2046 - protein, 119 aa, Artificial Sequence
  Description of Artificial Sequence: Synthetic heavy chain variable domain
QVQLKQSGPGLVQPSQSLSITCTVSGFSMTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2047 - protein, 119 aa, Artificial Sequence
  Description of Artificial Sequence: Synthetic heavy chain variable domain
QVQLKQSGPGLVQPSQSLSITCTVSGFSNTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2048 - protein, 119 aa, Artificial Sequence
  Description of Artificial Sequence: Synthetic heavy chain variable domain
QVQLKQSGPGLVQPSQSLSITCTVSGFSSTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2049 - protein, 119 aa, Artificial Sequence
  Description of Artificial Sequence: Synthetic heavy chain variable domain
QVQLKQSGPGLVQPSQSLSITCTVSGFSVTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2050 - protein, 119 aa, Artificial Sequence
  Description of Artificial Sequence: Synthetic heavy chain variable domain
QVQLKQSGPGLVQPSQSLSITCTVSGFVLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2051 - protein, 119 aa, Artificial Sequence
  Description of Artificial Sequence: Synthetic heavy chain variable domain
QVQLKQSGPGLVQPSQSLSITCTVSGFWLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2052 - protein, 449 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2053 - protein, 449 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2054 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDEEFAYWGPGTLVTVSA

SEQ ID NO: 2055 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDEEFAYWGPGTLVTVSS

SEQ ID NO: 2056 - protein, 449 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2057 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDEEFAYWGQGTLVTVSA

SEQ ID NO: 2058 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDEEFAYWGQGTLVTVSS

SEQ ID NO: 2059 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDDEFAYWGQGTLVTVSA

SEQ ID NO: 2060 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDDEFAYWGPGTLVTVSA

SEQ ID NO: 2061 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDDEFAYWGQGTLVTVSA

SEQ ID NO: 2062 - protein, 119 aa, Artificial Sequence
  Description of Artificial Sequence: Synthetic heavy chain variable domain
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2063 - protein, 119 aa, Artificial Sequence
  Description of Artificial Sequence: Synthetic heavy chain variable domain
QVQLKQSGPGLVQPSQSLSITCTVSGHSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2064 - protein, 119 aa, Artificial Sequence
  Description of Artificial Sequence: Synthetic heavy chain variable domain
QVQLKQSGPGLVQPSQSLSITCTVSGLSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2065 - protein, 119 aa, Artificial Sequence
  Description of Artificial Sequence: Synthetic heavy chain variable domain
QVQLKQSGPGLVQPSQSLSITCTVSGMSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2066 - protein, 119 aa, Artificial Sequence
  Description of Artificial Sequence: Synthetic heavy chain variable domain
QVQLKQSGPGLVQPSQSLSITCTVSGPSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2067 - protein, 119 aa, Artificial Sequence
  Description of Artificial Sequence: Synthetic heavy chain variable domain
QVQLKQSGPGLVQPSQSLSITCTVSGQSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2068 - protein, 119 aa, Artificial Sequence
  Description of Artificial Sequence: Synthetic heavy chain variable domain
QVQLKQSGPGLVQPSQSLSITCTVSGRSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2069 - protein, 119 aa, Artificial Sequence
  Description of Artificial Sequence: Synthetic heavy chain variable domain
QVQLKQSGPGLVQPSQSLSITCTVSGSSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2070 - protein, 119 aa, Artificial Sequence
  Description of Artificial Sequence: Synthetic heavy chain variable domain
QVQLKQSGPGLVQPSQSLSITCTVSGTSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2071 - protein, 119 aa, Artificial Sequence
  Description of Artificial Sequence: Synthetic heavy chain variable domain
QVQLKQSGPGLVQPSQSLSITCTVSGVSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2072 - protein, 119 aa, Artificial Sequence
  Description of Artificial Sequence: Synthetic heavy chain variable domain
QVQLKQSGPGLVQPSQSLSITCTVSGWSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2073 - protein, 119 aa, Artificial Sequence
  Description of Artificial Sequence: Synthetic heavy chain variable domain
QVQLKQSGPGLVQPSQSLSITCTVSGYSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2074 - protein, 119 aa, Artificial Sequence
  Description of Artificial Sequence: Synthetic heavy chain variable domain
QVQLKQSGPGLVQPSQSLSITCTVSHFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2075 - protein, 119 aa, Artificial Sequence
  Description of Artificial Sequence: Synthetic heavy chain variable domain
QVQLKQSGPGLVQPSQSLSITCTVSLFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2076 - protein, 119 aa, Artificial Sequence
  Description of Artificial Sequence: Synthetic heavy chain variable domain
QVQLKQSGPGLVQPSQSLSITCTVSMFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2077 - protein, 119 aa, Artificial Sequence
  Description of Artificial Sequence: Synthetic heavy chain variable domain
QVQLKQSGPGLVQPSQSLSITCTVSNFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2078 - protein, 119 aa, Artificial Sequence
  Description of Artificial Sequence: Synthetic heavy chain variable domain
QVQLKQSGPGLVQPSQSLSITCTVSPFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2079 - protein, 119 aa, Artificial Sequence
  Description of Artificial Sequence: Synthetic heavy chain variable domain
QVQLKQSGPGLVQPSQSLSITCTVSQFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2080 - protein, 119 aa, Artificial Sequence
  Description of Artificial Sequence: Synthetic heavy chain variable domain
QVQLKQSGPGLVQPSQSLSITCTVSRFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2081 - protein, 119 aa, Artificial Sequence
  Description of Artificial Sequence: Synthetic heavy chain variable domain
QVQLKQSGPGLVQPSQSLSITCTVSSFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2082 - protein, 119 aa, Artificial Sequence
  Description of Artificial Sequence: Synthetic heavy chain variable domain
QVQLKQSGPGLVQPSQSLSITCTVSYFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2083 - protein, 119 aa, Artificial Sequence
  Description of Artificial Sequence: Synthetic heavy chain variable domain
QVQLKQSGPGLVQPSQSLSITCTVTGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2084 - protein, 119 aa, Artificial Sequence
  Description of Artificial Sequence: Synthetic heavy chain variable domain
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDDEFAYWGPGTLVTVSA

SEQ ID NO: 2085 - protein, 119 aa, Artificial Sequence
  Description of Artificial Sequence: Synthetic heavy chain variable domain
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDDEFAYWGQGTLVTVSA

SEQ ID NO: 2086 - protein, 119 aa, Artificial Sequence
  Description of Artificial Sequence: Synthetic heavy chain variable domain
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDDEFAYWGPGTLVTVSA

SEQ ID NO: 2087 - protein, 119 aa, Artificial Sequence
  Description of Artificial Sequence: Synthetic heavy chain variable domain
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDDEFAYWGQGTLVTVSA

SEQ ID NO: 2088 - protein, 119 aa, Artificial Sequence
  Description of Artificial Sequence: Synthetic heavy chain variable domain
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2089 - protein, 119 aa, Artificial Sequence
  Description of Artificial Sequence: Synthetic heavy chain variable domain
QVQLKQSGPGLVQPSQSLSITCVVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2090 - protein, 119 aa, Artificial Sequence
  Description of Artificial Sequence: Synthetic heavy chain variable domain
QVQLKQSGPGLVQPSQSLSITCWVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2091 - protein, 119 aa, Artificial Sequence
  Description of Artificial Sequence: Synthetic heavy chain variable domain
QVQLQQSGPGLVKPSQTLSLTCAISGFSLFNYGVHWIRQSPSRGLEWLGVIWSGGNTDYNTPFTSRLTISKDTSKNQVVLTMTNMDPVDTATYYCARALTYYDDEFAYWGPGTLVTVSA

SEQ ID NO: 2092 - protein, 119 aa, Artificial Sequence
  Description of Artificial Sequence: Synthetic heavy chain variable domain
QVQLQQSGPGLVKPSQTLSLTCAISGFSLTNYGVHWIRQPPGKGLEWIGVIWSGGNTDYNTPFTSRFTISRDDSKNTAYLQMNSLKTEDTAVYYCARALTYYDDEFAYWGPGTLVTVSA

SEQ ID NO: 2093 - protein, 107 aa, Artificial Sequence
  Description of Artificial Sequence: Synthetic heavy chain variable domain
WILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 2094 - protein, 107 aa, Artificial Sequence
  Description of Artificial Sequence: Synthetic heavy chain variable domain
WILLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 2095 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDDEFAYWGQGTLVTVSA

SEQ ID NO: 2096 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDDEFAYWGPGTLVTVSA

SEQ ID NO: 2097 - protein, 119 aa, Artificial Sequence
  Description of Artificial Sequence: Synthetic heavy chain variable domain
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDDEFAYWGQGTLVTVSA

SEQ ID NO: 2098 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDDEFAYWGQGTLVTVSA

SEQ ID NO: 2099 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDYEFAYWGQGTLVTVSA

SEQ ID NO: 2100 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDDEFAYWGPGTLVTVSA

SEQ ID NO: 2101 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDDEFAYWGQGTLVTVSA

SEQ ID NO: 2102 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDDEFAYWGQGTLVTVSA

SEQ ID NO: 2103 - protein, 119 aa, Artificial Sequence
  Description of Artificial Sequence: Synthetic heavy chain variable domain
EVQLVQSGAEVKKPGATVKISCKVSGFSLFNYGVHWVRQARGQRLEWIGVIWSGGNTDYNTPFTSRFTISRDDSKNTAYLQMNSLKTEDTAVYYCARALTYYDDEFAYWGPGTLVTVSA

SEQ ID NO: 2104 - protein, 107 aa, Artificial Sequence
  Description of Artificial Sequence: Synthetic heavy chain variable domain
  MOD_RES (53)..(53): Any amino acid
  MOD_RES (94)..(94): Any amino acid
DILLTQSPVILSVSPGERVSFSCRASQSIGTNIHWYQQRTNGSPRLLIKYASXSISGIPSRFSGSGSGTDFTLSINSVESEDIADYYCQQNNNXPTTFGAGTKLELK

SEQ ID NO: 2105 - protein, 97 aa, Artificial Sequence
  Description of Artificial Sequence: Synthetic heavy chain variable domain
QCQSVEESGGRLVTPGTPLTLTCTVSGFSLNTYGVSWVRQAPGKGLEWIGYIFTDGQTYYASWAKGRFTISKTSSTTVDLKITSPTTEDTATYFCAS

SEQ ID NO: 2106 - protein, 99 aa, Artificial Sequence
  Description of Artificial Sequence: Synthetic heavy chain variable domain
HCQSLEESGGGLVKPGASLTLTCTASGFSFSNNDWMCWVRQAPGKGLEWICIYGGSSIGTNYAGWAKGRFTISRTSSTTVALQMTSLTVADTATYFCTR

SEQ ID NO: 2107 - protein, 118 aa, Artificial Sequence
  Description of Artificial Sequence: Synthetic heavy chain variable domain
QVELVESGGGVVQPGRSQRLSCAASGFTFSSYGMHWVRQAPGKGLEWVAIIWFDGSSTYYADSVRGRFTISRDNSKNTLYLQMNSLRAEDTAVYFCARELGRRYFDLWGRGTLVSVSS

SEQ ID NO: 2108 - protein, 120 aa, Artificial Sequence
  Description of Artificial Sequence: Synthetic heavy chain variable domain
QVNLLQSGAALVKPGASVKLSCKGSGFTFTDYKIHWVKQSHGKSLEWIGYFNPNSGYSTYNEKFKSKATLTADKSTDTAYMELTSLTSEDSATYYCTRLSPGGYYVMDAWGQGASVTVSS

SEQ ID NO: 2109 - protein, 118 aa, Artificial Sequence
  Description of Artificial Sequence: Synthetic heavy chain variable domain
QVQLVESGGGVVQPGRSLRLSCAASGFTFSSYGMHWVRQAPGKGLEWMAIIWFDGSSKYYGDSVKGRFTISRDNSKNTLYLQMNSLRADDTAVYYCARELGRRYFDLWGRGTLVTVSS

SEQ ID NO: 2110 - protein, 120 aa, Artificial Sequence [sequence omitted]

SEQ ID NO: 2111 - protein, 116 aa, Artificial Sequence
  Description of Artificial Sequence: Synthetic heavy chain variable domain
DVQLQESGPSLVKPSQSLSLTCTVTGYSITSDYAWNWIRQFPGNKLEWMGYISYSANTRYNPSLKSRISITRDTSKNQFFLQLNSVTTEDTATYYCATAGRGFPYWGQGTLVTVSA

SEQ ID NO: 2112 - protein, 116 aa, Artificial Sequence
  Description of Artificial Sequence: Synthetic heavy chain variable domain
DVQLQESGPSLVKPSQTLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSA

SEQ ID NO: 2113 - protein, 116 aa, Artificial Sequence
  Description of Artificial Sequence: Synthetic heavy chain variable domain
DVQLQGSGPSLVKPSQSLSLTCTVTGYSITSDYAWNWIRQFPGNKLEWMGYISYSGNTRYNPSLRSRISITRDTSKNQFFLQLNSVTTEDTATYYCATAGRGFPYWGQGTLVTVSA

SEQ ID NO: 2114 - protein, 116 aa, Artificial Sequence
  Description of Artificial Sequence: Synthetic heavy chain variable domain
LVKLQESGPSLVKPSQSLSLTCTVTGYSITSDYAWNWIRQFPGNKLEWMGYISYSANTRYNPSLKSRISITRDTSKNQFFLQLNSVTTEDTATYYCATAGRGFPYWGQGTLVTVSA

SEQ ID NO: 2115 - protein, 135 aa, Artificial Sequence
  Description of Artificial Sequence: Synthetic heavy chain variable domain
MDWTWRILFLVAAATGVHSQVQLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSS

SEQ ID NO: 2116 - protein, 134 aa, Artificial Sequence
  Description of Artificial Sequence: Synthetic heavy chain variable domain
MRVLILLWLFTAFPGVLSDVQLQESGPSLVKPSQSLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSA

SEQ ID NO: 2117 - protein, 116 aa, Artificial Sequence
  Description of Artificial Sequence: Synthetic heavy chain variable domain
QVQLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSS

SEQ ID NO: 2118 - protein, 116 aa, Artificial Sequence
  Description of Artificial Sequence: Synthetic heavy chain variable domain
QVQLQESGPGLVKPSQTLSLTCTVSGYSISSDFAWNWIRQPPGKGLEWMGYISYSGNTRYQPSLKSRITITRDTSKSQFFLQLNSVTAPDTATYYCVTAGRGFPYWGQGTLVTVSS

SEQ ID NO: 2119 - protein, 106 aa, Artificial Sequence
  Description of Artificial Sequence: Synthetic heavy chain variable domain
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2120 - protein, 658 aa, Artificial Sequence
  Description of Artificial Sequence: Synthetic heavy chain variable domain
MATGSRTSLLLAFGLLCLPWLQEGSAGSADILMTQSPSSMSVSLGDTVSITCHSSQDINSNIGWLQQRPGKSFKGLIYHGTNLDDEVPSRFSGSGSGADYSLTISSLESEDFADYYCVQYAQFPWTFGGGTKLEIKRGGGGSGGGGSGGGGSDVQLQESGPSLVKPSQSLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSAAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQLDDIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKGGGGSGGGGSGGGGSEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSS

SEQ ID NO: 2121 - protein, 232 aa, Artificial Sequence [sequence omitted]

SEQ ID NO: 2122 - protein, 291 aa, Artificial Sequence
  Description of Artificial Sequence: Synthetic heavy chain variable domain
MATGSRTSLLLAFGLLCLPWLQEGSAQVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSSAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 2123 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 2124 - protein, 119 aa, Artificial Sequence
  Description of Artificial Sequence: Synthetic heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSS

SEQ ID NO: 2125 - protein, 122 aa, Artificial Sequence
  Description of Artificial Sequence: Synthetic heavy chain variable domain
EVQLVESGGGLVQPGGSLRLSCAASGFPFSSYDMHWVRQATGKGLEWVSAIGTAGATYYPGSVKGRFTISRENAKNSLYLQMNSLRAGDTAVYYCARGDYVWGTYRPLFDYWGQGTLVTVSS

SEQ ID NO: 2126 - protein, 126 aa, Artificial Sequence
  Description of Artificial Sequence: Synthetic heavy chain variable domain
EVQLVESGGGLVQPGRSLRLSCAASGFTFDDYAMHWVRQVPGKGLEWVSGISWNSGSIGYADSVKGRFTISRDNAKNSLYLQMNSLRAEDTALYYCAKDIHDYGKDYYYYYGMDVWGQGTTVTVSS

SEQ ID NO: 2127 - protein, 119 aa, Artificial Sequence
  Description of Artificial Sequence: Synthetic heavy chain variable domain
QVQLQQWGAGLLKPAETLSLTCAVYGGSFSGNYWSWIRQSPGKGLEWIGEINHRGNSNYNPSLKSRGTISLDTSKNQLSLKLRSVTAADTAMYYCVRGGGDYYFGMDVWGQGTTVTVSS

SEQ ID NO: 2128 - protein, 119 aa, Artificial Sequence
  Description of Artificial Sequence: Synthetic heavy chain variable domain
QVQLQQWGAGLLKPSETLSLTCAVYGGSFSGDYWSWIRQSPGKGLEWIGEINHSGSTNYNPSLKSRVTISIDTSKNQFSLKLSSVTAADTAVYYCARGGGDYYYGMDVWGLGTTVTVSS

SEQ ID NO: 2129 - protein, 119 aa, Artificial Sequence
  Description of Artificial Sequence: Synthetic heavy chain variable domain
QVQLQQWGAGLLKPSETLSLTCAVYGGSFSGYYWSWIRQSPGKGLEWIGEINHSGSTNYNPSLKSRVTISVDTSKNQFSLKLTSVTAADTAVYFCARGGGTYYYGMDVWGQGTTVTVSS

SEQ ID NO: 2130 - protein, 118 aa, Artificial Sequence
  Description of Artificial Sequence: Synthetic heavy chain variable domain
QVQLVESGGGVVQPGRSLRLSCAASGFTFSAYAMHWVRQAPGKGLEWVAVIWYDGSNKNYADSVKGRFTVSRDNSKNTLYLEMNSLRAEDTAVYYCARDLMVGVTNYWGQGTLVTVST

SEQ ID NO: 2131 - protein, 124 aa, Artificial Sequence
  Description of Artificial Sequence: Synthetic heavy chain variable domain
QVQLVESGGGVVQPGRSLRLSCAASGFTFSRYGIHWVRQAPGKGLEWVAVIWHDGSNKYYADSVKGRFTISRDNSKNTLYLQMTSLRAEDTAVYYCARDGLEIRDHYYYGMDVWGQGTTVTVSS

SEQ ID NO: 2132 - protein, 124 aa, Artificial Sequence
  Description of Artificial Sequence: Synthetic heavy chain variable domain
QVQLVESGGGVVQPGRSRRLSCVGSGFIFSSYGMHWVRQAPGKGLEWVALIFYDGSNEYYVDSVKGRFTISRDNSKNTLYLQMNSLRAEDTAVYYCAREGYSQRYKYYFGMDVWGQGTTVTVSS

SEQ ID NO: 2133 - protein, 118 aa, Artificial Sequence
  Description of Artificial Sequence: Synthetic heavy chain variable domain
QVQLVQSGAEVKKPGASVKVSCKASGYTFTSYDINWVRQATGQGLEWMGWINPNSDYTGYVQKFQGRVTMTRDTSISTAYMELSSLRSEDTAVYYCATSRWSEHFHHWGQGTLVTVSS

SEQ ID NO: 2134 - protein, 116 aa, Artificial Sequence
  Description of Artificial Sequence: Synthetic heavy chain variable domain
EGQLLESGGGWVQPGESLRLSCAASGFTFSSYAMSWVRQAPGKGLEWVSAISGSGGSTNYADSVKGRFTISRDNSKNTLYLQVNSLRVEDTAVYYCAGSSGWSEYWGQGTLVTVSS

SEQ ID NO: 2135 - protein, 126 aa, Artificial Sequence
  Description of Artificial Sequence: Synthetic heavy chain variable domain
QVQLQESGPFLVKPSQTLSLTCTVSGGSISSGGYYWSWIRQHPGKGLEWIGFIYYRGNTYYNPSLKSRVTISVDTSKNQFSLKLSSVTAADTAVYYCARDGYCSRTGCYGGWFDPWGQGTLVTVSP

SEQ ID NO: 2136 - protein, 118 aa, Artificial Sequence
  Description of Artificial Sequence: Synthetic heavy chain variable domain
QVQLQQSGPGLVKPSQTLSLTCAISGDSVSSNNAAWNWIRQSPARGLEWLGRTYYRSKWYNDYVVSVKSRITINPDTSKNQFSLQLNSVTPEDTAVYYCVRATAFDYWGQGTLVTVSS

SEQ ID NO: 2137 - protein, 118 aa, Artificial Sequence
  Description of Artificial Sequence: Synthetic heavy chain variable domain
QVQLQQSGPGLVKPSQTLSLTCAISGDSVSSYSSAWNWIRQSPSRGLEWLGRAYHRSRWYYEYAVSVKSRINITPDTSKNQFSLQLNSVTPEDTAVYYCARGSRFDYWGQGTLVTVSS

SEQ ID NO: 2138 - protein, 110 aa, Artificial Sequence
  Description of Artificial Sequence: Synthetic heavy chain variable domain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARWGQGTLVTVSSA

SEQ ID NO: 2139 - protein, 121 aa, Artificial Sequence
  Description of Artificial Sequence: Synthetic heavy chain variable domain
QVQLVESGGGVVQPGRSLRLSCAASGFTFSSYGMHWVRQAPGKGLEWVAVIWYDGSNKYYVDSVKGRFTISRDNSKNTLYLQMNSLRAEDTAVYYCARDGWQQLAPFDYWGQGTLVTVSSA

SEQ ID NO: 2140 - protein, 170 aa, Artificial Sequence
  Description of Artificial Sequence: Synthetic heavy chain variable domain
QVQLVESGGGVVQPGRSLRLSCAASGFTFSSYGMHWVRQAPGKGLEWVAVIWYDGSNKYYVDSVKGRFTISRDNSKNTLYLQMNSLRAEDTAVYYCARDGWQQLAPFDYWGQGTLVTVSSASTKGPSVFPLAPSSKSTSGGTAALGCLVKDYFPEPVTVSWNSGALTSGV

SEQ ID NO: 2141 - protein, 128 aa, Artificial Sequence
  Description of Artificial Sequence: Synthetic heavy chain variable domain
QVQLVESGGGVVQPGRSLRLSCAASGFTLSSYGMHWVRQAPGKGLEWVAVMSYDGSKEDYADSVKGRFTISRDNSENTLYLQMNSLRAEDTAVYYCVSEGYCSSRSCYKYYYYGMDVWGQGTTVTVSS

SEQ ID NO: 2142 - protein, 128 aa, Artificial Sequence
  Description of Artificial Sequence: Synthetic heavy chain variable domain
QVQLVESGGGVVQPGRSLRLSCVASGFTLSSYGMHWVRQALGKGLEWVAVTSYDGSKKDYADSVKGRFTISRDNSKNTLYLQMNSLRAEDTAVYYCVSEGYCDSTSCYKYYYYGMDVWGQGTTVTVSS

SEQ ID NO: 2143 - protein, 128 aa, Artificial Sequence
  Description of Artificial Sequence: Synthetic heavy chain variable domain
QVQLVESGGGVVQPGRSLRLSCVASGFTLSSYGMHWVRQAPGKGLEWVAVTSYDGSKKDYADSAKGRFTISRDNSKNTLYLQMNSLRAEDTAVYYCVSEGYCSSSSCYKYYYYGMDVWGQGTTVTVSS

SEQ ID NO: 2144 - protein, 128 aa, Artificial Sequence
  Description of Artificial Sequence: Synthetic heavy chain variable domain
QVQLVESGGGVVQPGRSLRLSCVASGFTLSSYGMHWVRQAPGKGLEWVAVTSYDGSKKDYADSVKGRFTISRDNSKNTLYLQMNSLRAEDTAVYYCVSEGYCDSSSCYKYYYYGMDVWGQGTTVTVSS

SEQ ID NO: 2145 - protein, 128 aa, Artificial Sequence
  Description of Artificial Sequence: Synthetic heavy chain variable domain
QVQLVESGGGVVQPGRSLRLSCVASGFTLSSYGMHWVRQAPGKGLEWVAVTSYDGSKKDYADSVKGRFTISRDNSKNTLYLQMNSLRAEDTAVYYCVSEGYCDSTSCYKYYYYGMDVWGQGTTVTVSS

SEQ ID NO: 2146 - protein, 124 aa, Artificial Sequence
  Description of Artificial Sequence: Synthetic heavy chain variable domain
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSS

SEQ ID NO: 2147 - protein, 118 aa, Artificial Sequence
  Description of Artificial Sequence: Synthetic heavy chain variable domain
QVQLQQSGGGLVKPGASLKLSCVTSGFTFRKFGMSWVRQTSDKRLEWVASISTGGYNTYYSDNVKGRFTISRENAKNTLYLQMSSLKSEDTALYYCTRGYSSTSYAMDYWGQGTTVTV

SEQ ID NO: 2148 - protein, 217 aa, Artificial Sequence
  Description of Artificial Sequence: Synthetic heavy chain variable domain
QLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2149 - protein, 122 aa, Artificial Sequence; identical to SEQ ID NO: 2125
  Description of Artificial Sequence: Synthetic heavy chain variable domain

SEQ ID NO: 2150 - protein, 116 aa, Artificial Sequence
  Description of Artificial Sequence: Synthetic heavy chain variable domain
EVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 2151 - protein, 118 aa, Artificial Sequence
  Description of Artificial Sequence: Synthetic heavy chain variable domain
EVQLVESGGGLVKPGGSLRLSCAASGFTFSDAWMDWVRQAPGKGLEWVGEIRSKASNHATYYAESVKGRFTISRDDSKNTLYLQMNSLKTEDTAVYYCTTWRRFFDSWGQGTLVTVSS

SEQ ID NO: 2152 - protein, 118 aa, Artificial Sequence
  Description of Artificial Sequence: Synthetic heavy chain variable domain
EVQLVESGGGLVKPGGSLRLSCAASGFTFSDAWMDWVRQAPGKGLEWVGEIRSKASNHATYYAESVKGRFTISRDDSKNTLYLQMNSLKTEDTAVYYCTRWRRFFDSWGQGTLVTVSS

SEQ ID NO: 2153 - protein, 118 aa, Artificial Sequence
  Description of Artificial Sequence: Synthetic heavy chain variable domain
EVQLVESGGGLVKPGGSLRLSCAASGFTFSDAWMDWVRQAPGKGLEWVAEIRSKASNHATYYAESVKGRFTISRDDSKNTVYLQMNSLKTEDTAVYYCTRWRRFFDSWGQGTLVTVSS

SEQ ID NO: 2154 - protein, 106 aa, Artificial Sequence
  Description of Artificial Sequence: Synthetic heavy chain variable domain
EIVLTQSPATLSLSPGERATLSCRASSSVSYMHWYQQKPGQAPRPWIYATSNLASGIPARFSGSGSGTDYTLTISSLEPEDFAVYYCQQWSSNPLTFGGGTKVEIK

SEQ ID NO: 2155 - protein, 115 aa, Artificial Sequence
  Description of Artificial Sequence: Synthetic heavy chain variable domain
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRYFDYWGQGTLVTVSS

SEQ ID NO: 2156 - protein, 118 aa, Artificial Sequence
  Description of Artificial Sequence: Synthetic heavy chain variable domain
EVQLVESGGGLVQPGGSLKLSCAASGFTFSDAWMDWVRQASGKGLEWVAEIRSKASNHATYYAESVKGRFTISRDDSKNTVYLQMNSLKTEDTAVYYCTRWRRFFDSWGQGTLVTVSS

SEQ ID NO: 2157 - protein, 118 aa, Artificial Sequence; identical to SEQ ID NO: 765
  Description of Artificial Sequence: Synthetic heavy chain variable domain

SEQ ID NO: 2158 - protein, 118 aa, Artificial Sequence
  Description of Artificial Sequence: Synthetic heavy chain variable domain
EVQLVESGGGLVKPGGSLRLSCAASGFTFSDAWMDWVRQAPGKGLEWVGEARSKASNHATYYAESVKGRFTISRDDSKNTLYLQMNSLKTEDTAVYYCTRWRRFFDSWGQGTLVTVSS

SEQ ID NO: 2159 - protein, 118 aa, Artificial Sequence; identical to SEQ ID NO: 766
  Description of Artificial Sequence: Synthetic heavy chain variable domain

SEQ ID NO: 2160 - protein, 118 aa, Artificial Sequence
  Description of Artificial Sequence: Synthetic heavy chain variable domain
EVQLVESGGGLVKPGGSLRLSCAASGFTFSDAWMDWVRQAPGKGLEWVGEIRSRASNHATYYAESVKGRFTISRDDSKNTLYLQMNSLKTEDTAVYYCTRWRRFFDSWGQGTLVTVSS

SEQ ID NO: 2161 - protein, 118 aa, Artificial Sequence; identical to SEQ ID NO: 767
  Description of Artificial Sequence: Synthetic heavy chain variable domain

SEQ ID NO: 2162 - protein, 121 aa, Artificial Sequence
  Description of Artificial Sequence: Synthetic heavy chain variable domain
QVQLQQPGSELVRPGASVQLSCKASGYSFTSYWMHWVRQRPGQGLQWIGNIYPGTGNTNYDEKFMNKATLTVDTYSSTTYMQLSSLTSEDSAVYYCARWGLVRYFFAMDYWGQGTSVTVSS

SEQ ID NO: 2163 - protein, 118 aa, Artificial Sequence
  Description of Artificial Sequence: Synthetic heavy chain variable domain
EVQLQQSGPELVKPGASMKISCRASGYSFTGYTMNWVRQSHGKNLEWIGLINPHNGGSSYNLKFKGKATLTVDKSSSTAYMELLSLTSEDSAVYYCVRWGDYGSFAYWGQGTLVTVSA

SEQ ID NO: 2164 - protein, 119 aa, Artificial Sequence
  Description of Artificial Sequence: Synthetic heavy chain variable domain
EVQLQQSGPELVKPGASVKISCKASGYSFTAYYMHWVKQSHVKSLEWIGLVNPYNGFSSYNQNFEDKASLTVDKFSSTAYMELHSLTSEDSAVYYCAREFYGYRYFDVWGAGTAVTVSS

SEQ ID NO: 2165 - protein, 121 aa, Artificial Sequence
  Description of Artificial Sequence: Synthetic heavy chain variable domain
QVQLVQPGAEVVKPGASVKLSCKASGYNFTSYWMHWVRQRPGQGLQWIGNIYPGTGNTNYDQKFQGKATLTVDTSTSTTYMQLSSLTSEDSAVYYCARWGLVRYFFAMDYWGQGTSVTVSS

SEQ ID NO: 2166 - protein, 121 aa, Artificial Sequence
  Description of Artificial Sequence: Synthetic heavy chain variable domain
QVQLVQPGAEVVKPGASVKLSCKASGYSFTSYWMHWVRQRPGQGLQWIGNIYPGTGNTNYDQKFQGKATLTVDTSTSTTYMQLSSLTSEDSAVYYCARWGLVRYFFAMDYWGQGTSVTVSS

SEQ ID NO: 2167 - protein, 121 aa, Artificial Sequence
  Description of Artificial Sequence: Synthetic heavy chain variable domain
QVQLVQPGAEVVKPGASVKLSCKASGYNFTSYWMHWVRQRPGQGLQWIGNIYPGTGNTNYDQKFQGKATLTVDTYTSTTYMQLSSLTSEDSAVYYCARWGLVRYFFAMDYWGQGTSVTVSS

SEQ ID NO: 2168 - protein, 118 aa, Artificial Sequence
  Description of Artificial Sequence: Synthetic heavy chain variable domain
EVQLLQSGGELVQPGASMRISCAASGYTFTGYTMNWVRQSPGKNLEWIGLINPHNGGSSYNDSFKGKATLTVDKSSSTAYMELLSLTAEDSAVYYCVRWGDYGSFAYWGQGTLVTVSS

SEQ ID NO: 2169 - protein, 118 aa, Artificial Sequence
  Description of Artificial Sequence: Synthetic heavy chain variable domain
EVQLLQSGGELVQPGASMRISCAASGYSFTGYTMNWVRQSPGKNLEWIGLINPHNGGSSYNDSFKGKATLTVDKSSSTAYMELLSLTAEDSAVYYCVRWGDYGSFAYWGQGTLVTVSS

SEQ ID NO: 2170 - protein, 119 aa, Artificial Sequence
  Description of Artificial Sequence: Synthetic heavy chain variable domain
QVQLVQSGAEVVKPGASVKISCKASGYTFTAYYMHWVKQSPVQSLEWIGLVNPYNGFSSYNQKFQGKASLTVDKSSSTAYMELHSLTSEDSAVYYCAREFYGYRYFDVWGQGTAVTVSS

SEQ ID NO: 2171 - protein, 119 aa, Artificial Sequence
  Description of Artificial Sequence: Synthetic heavy chain variable domain
QVQLVQSGAEVVKPGASVKISCKASGYSFTAYYMHWVKQSPVQSLEWIGLVNPYNGFSSYNQKFQGKASLTVDKSSSTAYMELHSLTSEDSAVYYCAREFYGYRYFDVWGQGTAVTVSS

SEQ ID NO: 2172 - protein, 119 aa, Artificial Sequence
  Description of Artificial Sequence: Synthetic heavy chain variable domain
QVQLVQSGAEVVKPGASVKISCKASGYTFTAYYMHWVKQSPGQSLEWIGLVNPYNGFSSYNQKFQGKASLTVDKSSSTAYMELHSLTSEDSAVYYCAREFYGYRYFDVWGQGTAVTVSS

SEQ ID NO: 2173 - protein, 119 aa, Artificial Sequence
  Description of Artificial Sequence: Synthetic heavy chain variable domain
QVQLVQSGAEVVKPGASVKISCKASGYSFTAYYMHWVKQSPGQSLEWIGLVNPYNGFSSYNQKFQGKASLTVDKSSSTAYMELHSLTSEDSAVYYCAREFYGYRYFDVWGQGTAVTVSS

SEQ ID NO: 2174 - protein, 120 aa, Artificial Sequence
  Description of Artificial Sequence: Synthetic heavy chain variable domain
EVQLQQSGPDLVKPGASVKISCKASGYRFTEYNMHWMKQSHGESLEWIGYIYPYNGDTGYRQKFKNMATLTADISSNTAYMELRSLTSDDSAVYFCARWGYGSGGGFTYWGQGTLVTVSA

SEQ ID NO: 2175 - protein, 119 aa, Artificial Sequence
  Description of Artificial Sequence: Synthetic heavy chain variable domain
EVQLQQSGPELVKPGASVKISCKASGYTFTDYNMHWVKQSHGKSLEWIGFIYPYNGGTGYNQRFKNKATLTVDTSSSTAYMEVRSLTSEDSAVYFCARGYYYGRHFDYWGQGTTLTVSS

SEQ ID NO: 2176 - protein, 119 aa, Artificial Sequence
  Description of Artificial Sequence: Synthetic heavy chain variable domain
EVQLQQSGPELVKPGTSVKISCKASGFTFTDYTMDWVKQSHGKSLEWIGDVNPNSGGSIYNQRFKGKASLTVDRSSRIVYMELRSLTFEDTAVYYCARNLGPSFYFDYWGQGTTLTVSS

SEQ ID NO: 2177 - protein, 119 aa, Artificial Sequence [sequence omitted]

SEQ ID NO: 2178 - protein, 117 aa, Artificial Sequence
  Description of Artificial Sequence: Synthetic heavy chain variable domain
EVQLVESGGGLVQPGGSLRLSCAASGFTFSSYWMHWVRQTPGKGLEWVANIKQDGSEKYYVDSVKGRFTISRDNAKNSLHLQMNSLRAEDTAAYYCASFRDYGMDVWGQGTTVTVSS

SEQ ID NO: 2179 - protein, 129 aa, Artificial Sequence
  Description of Artificial Sequence: Synthetic heavy chain variable domain
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGPITIVRGVYYYFYGMDVWGQGTTVTVSS

SEQ ID NO: 2180 - protein, 121 aa, Artificial Sequence
  Description of Artificial Sequence: Synthetic heavy chain variable domain
EVQLVESGGGLVKPGGSLRLSCAASGFTFSSYSMNWVRQAPGKGLEWVSSISSSSSYIYYADSVKGRFTISRDNAKNSLYLQMNSLSAEDTAVYSCARGGDGYNYYYFDYWGQGTLVTVSS

SEQ ID NO: 2181 - protein, 121 aa, Artificial Sequence
  Description of Artificial Sequence: Synthetic heavy chain variable domain
EVQLVESGGGLVKPGGSLRLSCAASGFTFSSYTMNWVRQAPGKGLEWVSSISSSSSYIYYADSVKGRFTISRDNAKNSLYLQMNSLSAEDTAVYSCARGGDGYNYYYFDYWGQGTLVTVSS

SEQ ID NO: 2182 - protein, 121 aa, Artificial Sequence
  Description of Artificial Sequence: Synthetic heavy chain variable domain
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGGDGYNYYYFDYWGQGTLVTVSS

SEQ ID NO: 2183 - protein, 112 aa, Artificial Sequence
  Description of Artificial Sequence: Synthetic heavy chain variable domain
DIVMTQTPLSLSVTPGQPASISCKSSQSLLHSDGKTYLYWYLQKPGQPPQPLIYEVSNRFSGVPDRFSGSGSGTDFTLKISRVEAEDVGIYYCMQSKQLPRTFGQGTKVEIK

SEQ ID NO: 2184 - protein, 113 aa, Artificial Sequence
  Description of Artificial Sequence: Synthetic heavy chain variable domain
DIVMTQFPDSLAVSLDERATINCKSSQSVFFRSNNKNCLAWYQQKPGQPPNLLIYWASTRESGVPDRFSGSGSGTDFTLTISSLQAEDVAFYYCQQYYSSPFTFGPGTKVDIK

SEQ ID NO: 2185 - protein, 123 aa, Artificial Sequence
  Description of Artificial Sequence: Synthetic heavy chain variable domain
EVQLVESGGGLVQPGGSLRLSCTASGFPFSSYDMHWVRQATGKGLEWVSAIGTAGDTFYPGSVKGRFTISRENAKNSLYLQMNSLRAGDTAVYYCAREGYSSGRYFYYGMDVWGQGTTVTVSS

SEQ ID NO: 2186 - protein, 112 aa, Artificial Sequence
  Description of Artificial Sequence: Synthetic heavy chain variable domain
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPRTFGQGTKVEIK

SEQ ID NO: 2187 - protein, 121 aa, Artificial Sequence
  Description of Artificial Sequence: Synthetic heavy chain variable domain
  MOD_RES (99)..(100): Any amino acid
  MOD_RES (106)..(106): Any amino acid
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARXXDGYNYXYFDYWGQGTLVTVSS

SEQ ID NO: 2188 - protein, 123 aa, Artificial Sequence
  Description of Artificial Sequence: Synthetic heavy chain variable domain
  MOD_RES (98)..(98): Any amino acid
  MOD_RES (103)..(104): Any amino acid
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARXGYSSXXYYYYGMDVWGQGTTVTVSS

SEQ ID NO: 2189 - protein, 117 aa, Artificial Sequence
  Description of Artificial Sequence: Synthetic heavy chain variable domain
  MOD_RES (98)..(101): Any amino acid
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAXXXXYGMDVWGQGTTVTVSS

SEQ ID NO: 2190 - protein, 117 aa, Artificial Sequence
  Description of Artificial Sequence: Synthetic heavy chain variable domain
  MOD_RES (98)..(99): Any amino acid
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAXXRDYGMDVWGQGTTVTVSS

SEQ ID NO: 2191 - protein, 121 aa, Artificial Sequence
  Description of Artificial Sequence: Synthetic heavy chain variable domain
EVQLVESGGGLVKPGGSLRLSCAASGFTFSSYSMNWVRQAPRKGLEWVSSISSSSSYIYYADSVKGRFTISRDNAKNSLYLQMNSLRAEDTAVYYCARGGDGYNYYYFDYWGQGTLVTVSS

SEQ ID NO: 2192 - protein, 120 aa, Artificial Sequence
  Description of Artificial Sequence: Synthetic heavy chain variable domain
  MOD_RES (57)..(57): Any amino acid
  MOD_RES (59)..(59): Any amino acid
EVQLVESGGGLVQPGGSLRLSCAASGFNIKDTYIHWVRQAPGKGLEWVARIYPTNGXTXYADSVKGRFTISADTSKNTAYLQMNSLRAEDTAVYYCSRWGGDGFYAMDYWGQGTLVTVSS

SEQ ID NO: 2193 - protein, 120 aa, Artificial Sequence [sequence omitted]

SEQ ID NO: 2194 - protein, 115 aa, Artificial Sequence
  Description of Artificial Sequence: Synthetic heavy chain variable domain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSS

SEQ ID NO: 2195 - protein, 115 aa, Artificial Sequence
  Description of Artificial Sequence: Synthetic heavy chain variable domain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSS

SEQ ID NO: 2196 - protein, 223 aa, Artificial Sequence
  Description of Artificial Sequence: Synthetic heavy chain variable domain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 2197 - protein, 223 aa, Artificial Sequence
  Description of Artificial Sequence: Synthetic heavy chain variable domain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 2198 - protein, 224 aa, Artificial Sequence
  Description of Artificial Sequence: Synthetic heavy chain variable domain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 2199 - protein, 227 aa, Artificial Sequence
  Description of Artificial Sequence: Synthetic heavy chain variable domain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 2200 - protein, 224 aa, Artificial Sequence
  Description of Artificial Sequence: Synthetic heavy chain variable domain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 2201 - protein, 227 aa, Artificial Sequence
  Description of Artificial Sequence: Synthetic heavy chain variable domain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 2202 - protein, 115 aa, Artificial Sequence [sequence omitted]

SEQ ID NO: 2203 - protein, 219 aa, Artificial Sequence
  Description of Artificial Sequence: Synthetic heavy chain variable domain
DIVMTQATPSVPVTPGESVSISCRSSKSLLHSNGITYLYWFLQRPGQSPQRLIYYMSNLASGVPDRFSGRGSGTDFTLRISRVEAEDVGVYYCMQSLEYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 2204 - protein, 469 aa, Artificial Sequence
  Description of Artificial Sequence: Synthetic heavy chain variable domain
METDTLLLWVLLLWVPGSTGQVQLVQSGAEVKKPGASVKVSCKASGYTFTENIIHWVRQAPGQGLEWMGWFHPGSGSIKYNEKFKDRVTMTADTSTSTVYMELSSLRSEDTAVYYCARHGGTGRGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2205 - protein, 120 aa, Artificial Sequence
  Description of Artificial Sequence: Synthetic heavy chain variable domain
QVQLVQSGAEVKKPGASVKVSCKASGYTFTENIIHWVRQAPGQGLEWMGWFHPGSGSIKYNEKFKDRVTMTADTSTSTVYMELSSLRSEDTAVYYCARHGGTGRGAMDYWGQGTLVTVSS

SEQ ID NO: 2206 - protein, 124 aa, Artificial Sequence
  Description of Artificial Sequence: Synthetic heavy chain variable domain
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSS

SEQ ID NO: 2207 - protein, 119 aa, Artificial Sequence
  Description of Artificial Sequence: Synthetic heavy chain variable domain
QVQLQQSGAELARPGASVNLSCKASGYTFTNNGINWLKQRTGQGLEWIGEIYPRSTNTLYNEKFKGKATLTADRSSNTAYMETELRSLTSEDSAVYFCARTLTAPFAFWGQGTLVTVSA

SEQ ID NO: 2208 - protein, 121 aa, Artificial Sequence
  Description of Artificial Sequence: Synthetic heavy chain variable domain
EVQLVETGGGVVQPGRSLRLSCAASGFTFSSYGMHWVRQAPGKGLEWVAVISHDGSNKYYADSVKGRFTISRDNSKDTLYLQMNSLRGEDTAVYYCARSNQWSGYFSFDYWGQGTLVTVSS

SEQ ID NO: 2209 - protein, 117 aa, Artificial Sequence
  Description of Artificial Sequence: Synthetic heavy chain variable domain
EVQLVQSGAEVKKPGASVKVSCKASGYTFTTYGISWVRQAPGQGLEWMGWINTYNGHTNYAQKLQGRATMTADTSTNTAYMELRSLRSDDTAVYYCARVIYGSGDYWGQGTLVTVSS

SEQ ID NO: 2210 - protein, 116 aa, Artificial Sequence
  Description of Artificial Sequence: Synthetic heavy chain variable domain
QVQLQESGPGLVKPSETLSLTCNVSGYSISSGYFWGWIRQPPGKGLEWIGSIYHSRSTYYNPSLKSRVTISVDTSKNQFSLKLNSVTAADTAVYYCARGYGYFDYWGQGTLVTVSS

SEQ ID NO: 2211 - protein, 120 aa, Artificial Sequence
  Description of Artificial Sequence: Synthetic heavy chain variable domain
EVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSS

SEQ ID NO: 2212 - protein, 120 aa, Artificial Sequence
  Description of Artificial Sequence: Synthetic heavy chain variable domain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSSGNMVSWKDMWGQGTLVTVSS

SEQ ID NO: 2213 - protein, 116 aa, Artificial Sequence
  Description of Artificial Sequence: Synthetic heavy chain variable domain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSS

SEQ ID NO: 2214 - protein, 118 aa, Artificial Sequence
  Description of Artificial Sequence: Synthetic heavy chain variable domain
QMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSS

SEQ ID NO: 2215 - protein, 117 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGPYDGFDSWGQGTLVTVSS

SEQ ID NO: 2216 - protein, 117 aa, Artificial Sequence
  Description of Artificial Sequence: Synthetic heavy chain variable domain
QMQLVQSGAEVKKPGASVKVSCKTSGFPFNIFGITWVRQAPGQGLEWMGWISGYNGNTDYPQKFQGRVTMSTDTSTSTAYMELRNLKSDDTAVYYCARGAYGGMDTWGQGTLVTVSS

SEQ ID NO: 2217 - protein, 118 aa, Artificial Sequence
  Description of Artificial Sequence: Synthetic heavy chain variable domain
EVQLVESGTEVKKPGASVKVSCKASGYMFTSYGLNWVRQAPGQGLEWMGWISANNGKTNYAKKFQDRVTMTRDTSTSTGYMELRSLRSDDTAVYYCARHIGGSYFDRWGQGTLVTVSS

SEQ ID NO: 2218 - protein, 119 aa, Artificial Sequence
  Description of Artificial Sequence: Synthetic heavy chain variable domain
EVQLVETGGGLVQPGGSLRLSCAASGFTFSSYAMSWVRQAPGKGLEWVSAISGSDGSTYYADSVKGRFTISRDNSKNTLYLQMNSLRDEDTAVYYCARSHEANLVGDWWGQGTLVTVSS

SEQ ID NO: 2219 - protein, 116 aa, Artificial Sequence
  Description of Artificial Sequence: Synthetic heavy chain variable domain
QVQLVQSGTEVKKPGASVRVACKASGYPFNKYDINWVRQAPGQGLEWMGGIIPIFRTTNYAQKFQGRVTITADESTSTAYMELSSLRSEDTAVYYCAREWFYWDIWGQGTLVTVSS

SEQ ID NO: 2220 - protein, 113 aa, Artificial Sequence
  Description of Artificial Sequence: Synthetic heavy chain variable domain
VKLQESGGGLVQPGGSRKLSCAASGTSIFGLHWVRQAPEKGLEWVAYISGDSNTIYYADTVKGRTISRDNPKNTLFLQMTSLRSEDTAMYYCARNSYYALDYWGQGTTVTVSS

SEQ ID NO: 2221 - protein, 117 aa, Artificial Sequence
  Description of Artificial Sequence: Synthetic heavy chain variable domain
VQLQESGGGLVQPGGSRKLSCTASGFTSSFGMHWVRQAPEKGLEWVAYISSGSNIYFADTVKGRFTISRDNPKNTLFLQMTSLRSEDTAMYYCARSEYYGSSHMDYWGQGTTVTVSS

SEQ ID NO: 2222 - protein, 125 aa, Artificial Sequence
  Description of Artificial Sequence: Synthetic heavy chain variable domain
EVQLVESGGGLVQPGGSLRLSCAASGFTFTSTGISWVRQAPGKGLEWVGRIYPTSGSTNYADSVKGRFTISADTSKNTAYLQMNSLRAEDTAVYYCARARTYGIYDLYVDYTEYVMDYWGQGTLV

SEQ ID NO: 2223 - protein, 125 aa, Artificial Sequence
  Description of Artificial Sequence: Synthetic heavy chain variable domain
EVQLVESGGGLVQPGGSLRLSCAASGFTFTSTGISWVRQAPGKGLEWVARIYPTNGSTNYADSVKGRFTISADTSKNTAYLQMNSLRAEDTAVYYCARARTYGIYDLYVDYTEYVMDYWGQGTLV

SEQ ID NO: 2224 - protein, 125 aa, Artificial Sequence
  Description of Artificial Sequence: Synthetic heavy chain variable domain
EVQLVESGGGLVQPGGSLRLSCAASGFTFSTTGISWVRQAPGKGLEWVARIYPLYGSTHYADSVKGRFTISADTSKNTAYLQMNSLRAEDTAVYYCARARTYGIYDLYVDYTEYVMDYWGQGTLV

SEQ ID NO: 2225 - protein, 117 aa, Artificial Sequence
  Description of Artificial Sequence: Synthetic heavy chain variable domain
EVQLVESGGGLVQPGGSLRLSCAASGYTFTNHWMNWVRQAPGKGLEWVGMILPVDSETTLEQKFKDRFTISADTSKNTAYLQMNSLRAEDTAVYYCTRGDISLFDYWGQGTLVTVSS

SEQ ID NO: 2226 - protein, 118 aa, Artificial Sequence
  Description of Artificial Sequence: Synthetic heavy chain variable domain
EVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSS

SEQ ID NO: 2227 - protein, 119 aa, Artificial Sequence
  Description of Artificial Sequence: Synthetic heavy chain variable domain
QVQLQESGPGLVKPSQTLSLTCTVSGGSISSCGFYWNWIRQHPGKGLEWIGYIYYSGSTYYNPSLKSRVTISLDTSKSQFSLKLSSLTAADTAVYYCARSTRLRGADYWGQGTMVTVSS

SEQ ID NO: 2228 - protein, 121 aa, Artificial Sequence
  Description of Artificial Sequence: Synthetic heavy chain variable domain
EVMLVESGGGLVKPGGSLKLSCAASGFTFSTYAMSWVRQTPEKRLEWVATITSGGSYTYYPDSVKGRFTISRDNAKNILYLQMSSLRSEDTAMYYCTRLRQIGLRGFSDYWGQGTTLTVSS

SEQ ID NO: 2229 - protein, 118 aa, Artificial Sequence
  Description of Artificial Sequence: Synthetic heavy chain variable domain
QVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSS

SEQ ID NO: 2230 - protein, 446 aa, Artificial Sequence
  Description of Artificial Sequence: Synthetic heavy chain variable domain
QVQLKESGPGLVAPSQSLSITCTVSGFSVTNYGVHWVRQPPGKGLEWLGVIWAGGITNYNSAFMSRLSISKDNSKSQVFLKMNSLQIDDTAMYYCASRGGHYGYALDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2231 - protein, 448 aa, Artificial Sequence
  Description of Artificial Sequence: Synthetic heavy chain variable domain
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2232 - protein, 448 aa, Artificial Sequence
  Description of Artificial Sequence: Synthetic heavy chain variable domain
QVQLKESGPGVVQPGQSLSISCAVSGFSVTNYGVHWVRQPPGKGLEWLGVIWAGGITNYNSAFMSRLTISKDNSKSTVYLKMNSLQAEDTAMYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2233 - protein, 446 aa, Artificial Sequence
  Description of Artificial Sequence: Synthetic heavy chain variable domain
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2234 - protein, 118 aa, Artificial Sequence
  Description of Artificial Sequence: Synthetic heavy chain variable domain
QVQLKESGPVLVAPSQTLSITCTVSGFSLASYNIHWVRQPPGKGLEWLGVIWAGGSTNYNSALMSRLSISKDNSKSQVFLQMNSLQTDDTAMYYCAKRSDDYSWFAYWGQGTLVTVSA

SEQ ID NO: 2235 - protein, 120 aa, Artificial Sequence
  Description of Artificial Sequence: Synthetic heavy chain variable domain
DVQLVESGGGLVQPGGSRKLSCAASGFTFSNFGMHWVRQAPEKGLEWVAYISSGGSSINYADTVKGRFTISRDNPKNTLFLQMTSLRSEDTAIYYCTRGGTGTRSLYYFDYWGQGATLIV

SEQ ID NO: 2236 - protein, 121 aa, Artificial Sequence
  Description of Artificial Sequence: Synthetic heavy chain variable domain
EVVVVESGGGFVKPGGSLKLSCAAAGFTFSRYAMSWVRQTPEKRLEWVATISSGGSHTYYPDSVKGRFTISRDNAKNTLYLQMSSLRSEDTAIYYCARPGYDRGAWFFDVWGAGTTVTVSS

SEQ ID NO: 2237 - protein, 119 aa, Artificial Sequence
  Description of Artificial Sequence: Synthetic heavy chain variable domain
EVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSS

SEQ ID NO: 2238 - protein, 118 aa, Artificial Sequence
  Description of Artificial Sequence: Synthetic heavy chain variable domain
QVQLQQSGGGLVKPGGSLTLSCAASRFTFSTYAMSWVRQTPAKRLEWVAYISSGGASTYYRDSVKGRFTISRDNAKNTLYLQMSSLRSEDTAMYYCARGGSRYAMDYWGQGTTVTVSS

SEQ ID NO: 2239 - protein, 122 aa, Artificial Sequence
  Description of Artificial Sequence: Synthetic heavy chain variable domain
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCIRETVFYYYAMDYWGQGTTVTVSS

SEQ ID NO: 2240 - protein, 119 aa, Artificial Sequence
  Description of Artificial Sequence: Synthetic heavy chain variable domain
EVQLLESGGGLVQPGGSLRLSCAASGFTFSDYYMYWVRQAPEKRLEWVAYISNGGGSSHYVDSVKGRFTISRDNAKNTLYLQMNSLRAEDTALYHCARGMDYGAWFAYWGQGTLVTVSS

SEQ ID NO: 2241 - protein, 120 aa, Artificial Sequence
  Description of Artificial Sequence: Synthetic heavy chain variable domain
EVQLQQSGPELVKPGASVKISCKASGYTFTDYNMDWVKQSHGKSLEWIGYIYPNNGGTGYNQKFKSKATLTVDKSSSTAYMELHSLTSEDSAVYYCATYGHYYGYMFAYWGQGTLVTVSA

SEQ ID NO: 2242 - protein, 125 aa, Artificial Sequence
  Description of Artificial Sequence: Synthetic heavy chain variable domain
EVQLVQSGAEVKKPGASVKVSCKASGYTFTDYNMDWVRQAPGQGLEWMGYIYPNNGGTGYNQKFKSKVTITVDTSTSTAYMELHSLRSEDTAVYYCATYGHYYGYMFAYWGQGTLVTVSSASTKG

SEQ ID NO: 2243 - protein, 125 aa, Artificial Sequence
  Description of Artificial Sequence: Synthetic heavy chain variable domain
EVQLVQSGAEVKKPGASVKVSCKASGYTFTDYNMDWVRQAPGQGLEWMGYIYPNNGGTGYNQKFKSRVTITADTSTSTAYMELSSLRSEDTAVYYCARYGHYYGYMFAYWGQGTLVTVSSASTKG

SEQ ID NO: 2244 - protein, 125 aa, Artificial Sequence
  Description of Artificial Sequence: Synthetic heavy chain variable domain
EVQLVQSGAEVKKPGASVKVSCKASGYTFTDYNMDWVKQSPGQGLEWMGYIYPNNGGTGYNQKFKSKVTITVDTSTSTAYMELHSLRSEDTAVYYCATYGHYYGYMFAYWGQGTLVTVSSASTKG

SEQ ID NO: 2245 - protein, 125 aa, Artificial Sequence
  Description of Artificial Sequence: Synthetic heavy chain variable domain
EVQLVQSGAEVKKPGASVKVSCKASGYTFTDYNMDWVKQSPGKSLEWMGYIYPNNGGTGYNQKFKSKVTITVDTSTSTAYMELHSLRSEDTAVYYCATYGHYYGYMFAYWGQGTLVTVSSASTKG

SEQ ID NO: 2246 - protein, 125 aa, Artificial Sequence
  Description of Artificial Sequence: Synthetic heavy chain variable domain
EVQLVQSGAEVKKPGASVKVSCKASGYTFTDYNMDWVRQAPGQGLEWMGYIYPNNGGTGYNQKFKSKATLTVDTSTSTAYMELHSLRSEDTAVYYCATYGHYYGYMFAYWGQGTLVTVSSASTKG

SEQ ID NO: 2247 - protein, 125 aa, Artificial Sequence
  Description of Artificial Sequence: Synthetic heavy chain variable domain
EVQLVQSGAEVKKPGASVKVSCKASGYTFTDYNMDWVKQSPGKSLEWMGYIYPNNGGTGYNQKFKSKATLTVDTSTSTAYMELHSLRSEDTAVYYCATYGHYYGYMFAYWGQGTLVTVSSASTKG

SEQ ID NO: 2248 - protein, 125 aa, Artificial Sequence
  Description of Artificial Sequence: Synthetic heavy chain variable domain
EVQLVQSGAEVKKPGASVKVSCKASGYTFTDYNMDWVKQSPGQGLEWMGYIYPNNGGTGYNQKFKSKATLTVDTSTSTAYMELHSLRSEDTAVYYCATYGHYYGYMFAYWGQGTLVTVSSASTKG

SEQ ID NO: 2249 - protein, 117 aa, Artificial Sequence
  Description of Artificial Sequence: Synthetic heavy chain variable domain
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARENIAAFDYWGQGTLVTVSS

SEQ ID NO: 2250 - protein, 116 aa, Artificial Sequence
  Description of Artificial Sequence: Synthetic heavy chain variable domain
EVQLLESGGGLVQPGGSLRLSCAASGFTFSSYAMSWVRQAPGKGLEWVSTIQKQGLPTQYADSVKGRFTISRDNSKNTLYLQMNSLRAEDTAVYYCAKNRAKFDYWGQGTLVTVSS

SEQ ID NO: 2251 - protein, 117 aa, Artificial Sequence
  Description of Artificial Sequence: Synthetic heavy chain variable domain
QVQLVQSGGGLVQPGGSLRLSCAASYFDFDSYEMSWVRQAPGKGLEWIGSIYHSGSTYYNPSLKSRVTISRDNSKNTLYLQMNTLRAEDTATYYCARVNMDRFDYWGQGTLVTVSSS

SEQ ID NO: 2252 - protein, 125 aa, Artificial Sequence
  Description of Artificial Sequence: Synthetic heavy chain variable domain
QVQLVQSGGGLVQPGGSLRLSCAASGFSFSTYEMSWVRQAPGKGLEWVSPISGSGGNSYYADSVKGRFTISRDNSKNTLYLQMNTLRAEDTAVYYCAKGPPVWSGYYFADGFDIWGQGTMVTVSS

SEQ ID NO: 2253 - protein, 116 aa, Artificial Sequence
  Description of Artificial Sequence: Synthetic heavy chain variable domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSYGAFDYWGQGTLVTVSS

SEQ ID NO: 2254 - protein, 120 aa, Artificial Sequence
  Description of Artificial Sequence: Synthetic heavy chain variable domain
EVQLLESGGGLVQPGGSLRLSCAASGFRISDEDMGWVRQAPGKGLEWVSSIYGPSGSTYYADSVKGRFTISRDNSKNTLYLQMNSLRAEDTAVYYCASALEPLSEPLGFWGQGTLVTVSS

SEQ ID NO: 2255 - protein, 115 aa, Artificial Sequence
  Description of Artificial Sequence: Synthetic heavy chain variable domain
QVQLVQSGGGLVQPGGSLRLSCAASGFTVSSNYMSWVRQAPGKGLEWVSVIYHGGTTYYTDSVKGRFTISRDNSKNTLYLQMNSLRAEDTAVYYCARANGAFDIWGQGTMVTVSS

SEQ ID NO: 2256 - protein, 116 aa, Artificial Sequence
  Description of Artificial Sequence: Synthetic heavy chain variable domain
QVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCARNFGEDFDYWGQGTLVTVSS

SEQ ID NO: 2257 - protein, 116 aa, Artificial Sequence
  Description of Artificial Sequence: Synthetic heavy chain variable domain
EVQLVESGGGLVQPGGSLRLSCAASGFTFSTYAMSWVRQAPGKGLEWVASISTGGSTYYPDSVKGRFTISRDNAKNTLYLQMNSLRAEDTAVYYCARDYDGYFDYWGQGTLVTVSS

SEQ ID NO: 2258 - protein, 124 aa, Artificial Sequence
  Description of Artificial Sequence: Synthetic heavy chain variable domain
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKGITMIVVVISDAFDIWGQGTMVTVSS

SEQ ID NO: 2259 - protein, 121 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTRYAQKFQGRVTMTRDTSTSTVYMELSSLRSEDTAVYYCARGSSRWGGWTGDYWGQGTLVTVSS

SEQ ID NO: 2260 - protein, 117 aa, Artificial Sequence
  Description of Artificial Sequence: Synthetic heavy chain variable domain
EVQLVETGGGLVQPGGSLRLSCAASGSTFSSYAMSWVRQAPGKGLEWVSAISGRGRSTYYADSVKGRFTISRDNSKNTLYLQMNSLRAEDTAVYYCARYYKSSKDHWGQGTLVTVSS

SEQ ID NO: 2261 - protein, 121 aa, Artificial Sequence
  Description of Artificial Sequence: Synthetic heavy chain variable domain
QVQLVQSGAEVQRPGASVRVSCKAIAYTFTDYYIHWVRQAPGQGPEWMGWINPKSGRTQYAPKFQDRVTLARETPISTASMELRGLTSDDTAVYYCARVYGYSRWSGFDLWGQGTLVTVSS

SEQ ID NO: 2262 - protein, 124 aa, Artificial Sequence
  Description of Artificial Sequence: Synthetic heavy chain variable domain
QVQLVQSGAEVKQPGASVKVSCQASGYTFTTYYMHWVRQAPGQGLEWMGIINPNGGGTFYAQKFQDRVTMTRDTSTGTVYMELSSLRSDDTAVYYCARGHKVYKSHPTGGYDRWGQGTLVTVSS

SEQ ID NO: 2263 - protein, 119 aa, Artificial Sequence
  Description of Artificial Sequence: Synthetic heavy chain variable domain
EVQLVQSGAEVKKPGSSVKVSCKASGGTFSSYAISWVRQAPGQGLEWMGGIIPIFGTAKYAQKFQGRVTITADESTSTAYMELSSLRSEDTAVYYCARSHVAWSLLDYWGQGTLVTVSS

SEQ ID NO: 2264 - protein, 121 aa, Artificial Sequence
  Description of Artificial Sequence: Synthetic heavy chain variable domain
QLQLQESGGGSVQPGGSLRLSCAASGFTFSNYAMSWVRQAPGKGLEWVSAITNSGRSTYYADSVKGRFTISRDNSKNTLSLQMSSLRAEDTAVYYCARVTHRRYGSTFDSRGQGTLVTVSS

SEQ ID NO: 2265 - protein, 121 aa, Artificial Sequence
  Description of Artificial Sequence: Synthetic heavy chain variable domain
QVQLVQSGAEVKKPGSSVKVSCKASGGTFRSYAITWVRQAPGQGLEWMGRIIPMLDITNYAQKFQGRVTITADKSTSTAYMELSSLRSEDTAVYYCARTYSRSPFHMEDFWGQGTLVTVSS

SEQ ID NO: 2266 - protein, 120 aa, Artificial Sequence
  Description of Artificial Sequence: Synthetic heavy chain variable domain
QVQLVQSGAEVKKPGSSVKVSCKASGGTFSSYAISWVRQAPGQGLEWMGWMNPNSGNTGYAQKFQGRVTMTRNTSISTAYMELSSLRSEDTAVYYCARYQSYKGSQSDSWGQGTLVTVSS

SEQ ID NO: 2267 - protein, 114 aa, Artificial Sequence
  Description of Artificial Sequence: Synthetic heavy chain variable domain
EVQLVESGGGLVQPGGSLRLSCAASGFTFSSYAMSWVRQAPGKGLEWVSAISGSGGSTYYADSVKGRFTISRDNAKNTLYLQMNSLRAEDTAVYYCARKYQDVWGQGTLVTVSS

SEQ ID NO: 2268 - protein, 122 aa, Artificial Sequence
  Description of Artificial Sequence: Synthetic heavy chain variable domain
QVQLVQSGGGVVQPGRSLRLSCAASGFSFSGTAMHWVRQAPGKGLEWVSTISSTGRSTYYRDSVKGRFTISRDNSKNTLYLQMNSLRGEDTAVYYCARPVSSMTLSIQSDGWGQGTLVTVSS

SEQ ID NO: 2269 - protein, 130 aa, Artificial Sequence
  Description of Artificial Sequence: Synthetic heavy chain variable domain
QMQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGQKYHSQYSRGGTGGGMTQDMWGQGTLVTVSS

SEQ ID NO: 2270 - protein, 127 aa, Artificial Sequence
  Description of Artificial Sequence: Synthetic heavy chain variable domain
EVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGGSKKWSGEKWRRENFDYWGQGTLVTVSS

SEQ ID NO: 2271 - protein, 117 aa, Artificial Sequence
  Description of Artificial Sequence: Synthetic heavy chain variable domain
EVQLVQSGAEVKKPGASVKVSCKASGYTFSRYYIHWVRQAPGQGLEWMGWMNPNSGNTGYAQKFQGRVTMTRNTSISTAYMELSSLRSEDTAVYYCARGRYHVIDYWGQGTLVTVSS

SEQ ID NO: 2272 - protein, 113 aa, Artificial Sequence
  Description of Artificial Sequence: Synthetic heavy chain variable domain
QLQLVQSGAEVKKPGSSVKVSCKASGYTFNTYYLHWVRQAPGQGLEWMGRINPNNGGTNYAQKFQGRVTMTRDTSINTAYMELSRLRSDDTAVYYCARSYDYWGQGTLVTVSS

SEQ ID NO: 2273 - protein, 113 aa, Artificial Sequence
  Description of Artificial Sequence: Synthetic heavy chain variable domain
QMQLVQSGAEVKKPGASVKVSCKASEYTFTRHILHWVRQAPGQSLEWMGWINPGNGNTKYSQKFQVRVTFTRDTSASTVYMELSSLRSEDTAVYYCARLPDQWGQGTLVTVSS

SEQ ID NO: 2274 - protein, 114 aa, Artificial Sequence
  Description of Artificial Sequence: Synthetic heavy chain variable domain
EVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKQDYWGQGTLVTVSS

SEQ ID NO: 2275 - protein, 114 aa, Artificial Sequence
  Description of Artificial Sequence: Synthetic heavy chain variable domain
EVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSS

SEQ ID NO: 2276 - protein, 116 aa, Artificial Sequence
  Description of Artificial Sequence: Synthetic heavy chain variable domain
EVQLVESGGGLVQPGGSLRLSCAASGFTFSNYAMSWVRQAPGKGLEWVSAISGSGNTYYADSVKGRFTISRDNSKNTLYLQMNSLRAEDTAVYYCARGSVRYTDIWGQGTLVTVSS

SEQ ID NO: 2277 - protein, 118 aa, Artificial Sequence
  Description of Artificial Sequence: Synthetic heavy chain variable domain
EVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSS

SEQ ID NO: 2278 - protein, 114 aa, Artificial Sequence
  Description of Artificial Sequence: Synthetic heavy chain variable domain
QMQLVQSGAEVKKPGASVKVSCKASGYTFNRYAITWVRQAPGQGLEWMGWISAYNGNSHYAQKLQGRVTMTTDTSTGTAYMELRRLRSDDTAVYYCARMAYDSWGQGTLVTVSS

SEQ ID NO: 2279 - protein, 117 aa, Artificial Sequence
  Description of Artificial Sequence: Synthetic heavy chain variable domain
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSS

SEQ ID NO: 2280 - protein, 119 aa, Artificial Sequence
  Description of Artificial Sequence: Synthetic heavy chain variable domain
QVQLVESGGGLVHPGGSLRLSCAASGFTFRSHSMNWVRQAPGKGLEWVSSISSDSTYTYYADSVKGRFTISRDNAKNSLYLQMNSLRAEDTAVYYCARSGGQWKYYDYWGQGTLVTVSS

SEQ ID NO: 2281 - protein, 116 aa, Artificial Sequence
  Description of Artificial Sequence: Synthetic heavy chain variable domain
EVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTV

SEQ ID NO: 2282 - protein, 116 aa, Artificial Sequence
  Description of Artificial Sequence: Synthetic heavy chain variable domain
QMQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARAGMGMDTWGQGTLVTVSS

SEQ ID NO: 2283 - protein, 117 aa, Artificial Sequence
  Description of Artificial Sequence: Synthetic heavy chain variable domain
QVQLVQSGAEVKKPGASVKVSCRASGYTFTAYSLHWVRQAPGQGLEWMGWINPSSGGAVYAQKFQGRVTMTRDTSISTAYMELSGLRSDDTAVYYCARNVGGQADDWGQGTLVTVSS

SEQ ID NO: 2284 - protein, 117 aa, Artificial Sequence
  Description of Artificial Sequence: Synthetic heavy chain variable domain
QVQLVQSGAEVKKPGASVKVSCRASGYTFTAYSLHWVRQAPGQGLEWMGWINPSSGGAVYAQKFQGRVTMTRDTSISTAYMELSGLRSDDTAVYYCARNVGGHADDWGQGTLVTVSS

SEQ ID NO: 2285 - protein, 129 aa, Artificial Sequence
  Description of Artificial Sequence: Synthetic heavy chain variable domain
QVQLVQSGGEVKKPGASVKVSCKASGFTFNTYGISWVRQAPGQGLEWMGWISANNGHTKSAQRFQDRVAMATDTSTSTAYMELRSLKFDDTAVYYCARGGYHHQMQRYYKATSVYSDYWGQGTLVTVSS

SEQ ID NO: 2286 - protein, 116 aa, Artificial Sequence
  Description of Artificial Sequence: Synthetic heavy chain variable domain
QMQLVQSGAEVKKPGASVKVSCKASGYTFTSYYMHWVRQAPGQGLEWMGIINPSGGSSSYAQKFQGRVTMTRDTSTSTVYMELSSLRSEDTAVYYCARAGMGMDTWGQGTLVTVSS

SEQ ID NO: 2287 - protein, 117 aa, Artificial Sequence
  Description of Artificial Sequence: Synthetic heavy chain variable domain
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDVISGFDSWGQGTLVTVSS

SEQ ID NO: 2288 - protein, 120 aa, Artificial Sequence
  Description of Artificial Sequence: Synthetic heavy chain variable domain
QVQLVQSGSELKKPGASVRVSCTASGYTFTSYYMHWVRQAPGQGLEWMGVINPNAGSTRYAQKFQGRVTMSTDTSTSTAYMDLSSLRSEDTAVYYCARGMYRSLLFYDPWGQGTLVTVSS

SEQ ID NO: 2289 - protein, 119 aa, Artificial Sequence
  Description of Artificial Sequence: Synthetic heavy chain variable domain
EVQLVQSGGGLVQPGGSLRLSCATSGFTFNNYWMSWVRQAPGKGLEWVANIKQDGSEKYYADSVRGRFTISRDNAKNSLSLQLNNLRAEDTAVYYCARSMSTAWGYDEWGQGTLVTVSS

SEQ ID NO: 2290 - protein, 118 aa, Artificial Sequence
  Description of Artificial Sequence: Synthetic heavy chain variable domain
EVQLVESGGGLVQPGGSLRLSCAASGFTLSGDWVIHWVRQAPGKGLEWVGEISAAGGYTDYADSVKGRFTISADTSKNTAYLQMNSLRAEDTAVYYCARESRVSFEAAMDYWGQGTLV

SEQ ID NO: 2291 - protein, 117 aa, Artificial Sequence
  Description of Artificial Sequence: Synthetic heavy chain variable domain
EVQLLESGGGLVQPGGSLRLSCAASGFTFSSYAMSWVRQAPGKGLEWVSAINSQGKSTYYADSVKGRFTISRDNSKNTLYLQMNSLRAEDTAVYYCARWGDEGFDIWGQGTLVTVSS

SEQ ID NO: 2292 - protein, 228 aa, Artificial Sequence
  Description of Artificial Sequence: Synthetic heavy chain variable domain
EVQLVESGGGLVQPGGSLRLSCAASGFNIKDTYIHWVRQAPGKGLEWVARIYPTNGYTRYADSVKGRFTISADTSKNTAYLQMNSLRAEDTAVVYCSRWGGDGFYAMDYWGQGTLVTVSSASTKGPSVFPLAPSSKSTSGGTAALGCLVKDYFPEPVTVSWNSGALTSGVHTFPAVLQSSGLVSLSSVVTVPSSSLGTQTVICNVNHKPSNTKVDKKVEPKSCDKTHT

SEQ ID NO: 2293 - protein, 233 aa, Artificial Sequence
  Description of Artificial Sequence: Synthetic heavy chain variable domain
DIQMTQSPSSLSASVGDRVTITCRASQDVNTAVAWYQQKPGKAPKLLIVSASFLVSGVPSRFSGSRSGTDFTLTISSLQPEDFATYVCQQHYTTPPTFGQGTKLEIKRTVAAPSVFIFPPSDEQLKSGTASVVCLLNNFYPREAKVQWKVDNALQSGNSQESVTEQDSKDSTVSLSSTLTLSKADYEKHKVVACEVTHQGLSSPVTKSFNRGECGGGGSNYHLENEVARLKKL

SEQ ID NO: 2294 - protein, 247 aa, Artificial Sequence
  Description of Artificial Sequence: Synthetic heavy chain variable domain
EVQLVESGGGLVQPGGSLRLSCAASGFNIKDTYIHWVRQAPGKGLEWVARIYPTNGYTRYADSVKGRFTISADTSKNTAYLQMNSLRAEDTAVVYCSRWGGDGFYAMDYWGQGTLVTVSSASTKGPSVFPLAPSSKSTSGGTAALGCLVKDYFPEPVTVSWNSGALTSGVHTFPAVLQSSGLVSLSSVVTVPSSSLGTQTVICNVNHKPSNTKVDKKVEPKSCDKTHTGGGGSNYHLENEVARLKKL

SEQ ID NO: 2295 - protein, 232 aa, Artificial Sequence
  Description of Artificial Sequence: Synthetic heavy chain variable domain
DIQMTQSPSSLSASVGDRVTITCRASQDVNTAVAWYQQKPGKAPKLLIVSASFLVSGVPSRFSGSRSGTDFTLTISSLQPEDFATYVCQQHYTTPPTFGQGTKLEIKRTVAAPSVFIFPPSDEQLKSGTASVVCLLNNFYPREAKVQWKVDNALQSGNSQESVTEQDSKDSTVSLSSTLTLSKADYEKHKVVACEVTHQGLSSPVTKSFNRGECGGGGSGGGGSDYKDDDDK

SEQ ID NO: 2296 - protein, 246 aa, Artificial Sequence
  Description of Artificial Sequence: Synthetic heavy chain variable domain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYVCSRWGGDGFYAMDYWGQGTLVTVSSASTKGPSVFPLAPSSKSTSGGTAALGCLVKDYFPEPVTVSWNSGALTSGVHTFPAVLQSSGLVSLSSVVTVPSSSLGTQTVICNVNHKPSNTKVDKKVEPKSCDKTHTGGGGSGGGGSDYKDDDDK

SEQ ID NO: 2297 - protein, 118 aa, Artificial Sequence
  Description of Artificial Sequence: Synthetic heavy chain variable domain
EVQLVQSGAEVKKPGASVKVSCKASGYSFTGYWMNWVRQAPGQGLEWIGMIHPLDAEIRANQKFRDRVTITVDTSTSTAYLELSSLRSEDTAVYYCARGTYDGGFEYWGQGTLVTVSS

SEQ ID NO: 2298 - protein, 227 aa, Artificial Sequence
  Description of Artificial Sequence: Synthetic heavy chain variable domain
QVQLVQSGGGVKKPGASVKVSCKASGYTFRSSYISWVRQSPGQGLEWMGWIYAGTGSPSYNQKLQGRVTMTTDTSTSTAYMELRSLRSDDTAIYYCARHRDYYSNSLTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 2299 - protein, 119 aa, Artificial Sequence
  Description of Artificial Sequence: Synthetic heavy chain variable domain
EVQLQESGGGLVQPKGSLKLSCAAFGFTFNTYAMHWVRQAPGKGLEWVARIRSKSNNYATYYADSVKDRFTISRDDSQSMLSLQMNNLKTEDTAIYYCVRGGYWSFDVWGAGTTVTVSS

SEQ ID NO: 2300 - protein, 117 aa, Artificial Sequence
  Description of Artificial Sequence: Synthetic heavy chain variable domain
QVQLQESGAELVKPGASVKLSCTASGFNIKDTYMHWVKQRPEQGLEWIGRIDPANGNTKYDPKFQGKATITADTSSNTAYLQLSSLTSEDTAVYYCARSYYGGFAYWGQGTLVTVSA

SEQ ID NO: 2301 - protein, 117 aa, Artificial Sequence
  Description of Artificial Sequence: Synthetic heavy chain variable domain
EVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSS

SEQ ID NO: 2302 - protein, 117 aa, Artificial Sequence
  Description of Artificial Sequence: Synthetic heavy chain variable domain
EVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSS

SEQ ID NO: 2303 - protein, 121 aa, Artificial Sequence
  Description of Artificial Sequence: Synthetic heavy chain variable domain
QVQLQQSGPELVKPGASVKISCKTSGYAFSFSWMNWVKWGPGQGLEWIGRIYPGNGDTNYNGKFKGKATLTADKSSNTAYMQLSSLTSVDSAVYFCARWVYSGNNYAVDYWGQGTSVTVSS

SEQ ID NO: 2304 - protein, 112 aa, Artificial Sequence
  Description of Artificial Sequence: Synthetic heavy chain variable domain
QIQLVQSGPELKKPGETVKISCKASGYTFTDYSMHWVKQAPGEGLKWMGWINTETGEPTYADDFKGRFAFSLETSASTAYLQINNLKNEDTATYFCYYGSYWGQGTLVTVSA

SEQ ID NO: 2305 - protein, 151 aa, Artificial Sequence
  Description of Artificial Sequence: Synthetic heavy chain variable domain
MSSPQTLNTLTLTMRWSWIFLFLLSGTAGVHSEYHLQQSGPVLVKPGASVKMSCKASGYTFTDYYMTWVKQSHEKSLEWIGIIDPYNGDTSYNQKFMGKATLTVDMSSSTAYMELNSLTSDDSAVYYCARDLDYWGRGTTLTVSPASTTPP

SEQ ID NO: 2306 - protein, 124 aa, Artificial Sequence
  Description of Artificial Sequence: Synthetic heavy chain variable domain
MGWLWNLLFLMAAAQSAQAQIQLVQSGPELKKPGETVKISCKASGYTFTTYGMSWVKQAPGKGLKWMGWINTYSGVPTYADDFKGRFAFSLETSASTAYLQINNLKNEDTATYFCARCYYGNYN

SEQ ID NO: 2307 - protein, 123 aa, Artificial Sequence
  Description of Artificial Sequence: Synthetic heavy chain variable domain
MGWLWNLLFLMAAAQSAQAQIQLVQSGPELKKPGETVKISCKASGYTFTTYGMSWVKQAPGKGLKWMGWINTYSGVPTYADDFKGRFAFSLETSASTAYLQINNLKNEDTATYFCARCYYGNY

SEQ ID NO: 2308 - protein, 123 aa, Artificial Sequence
  Description of Artificial Sequence: Synthetic heavy chain variable domain
EVMLVESGGGLVKPGGSLKLSCAASGFTFSSYAMSWVRQTPEKRLEWVATITSGGDYTFYPDSVKGRFTISRDNAKNTLYLQMSSRRSEDTAMYYCARHGEIGYGSSAWFAYWGQGTLVTVSA

SEQ ID NO: 2309 - protein, 463 aa, Artificial Sequence
  Description of Artificial Sequence: Synthetic heavy chain variable domain
MGWSCIIVLLVSTATGVHSQVQLQQPGAELVRPGTSVKLSCKASGYTFTSHWLHWVKQRPGQGLEWIGVLDPSDFYSNYNQNFKGKATLTVDTSSSTAYMQLSSLTSEDSAVYYCARGLLSGDYAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 2310 - protein, 475 aa, Artificial Sequence
  Description of Artificial Sequence: Synthetic heavy chain variable domain
MGRLTSSFLLLIVPAYVLSQVTLKESGPGILRPSQTLSLTCSFSGFSLSTFGLSVGWIRQPSGKGLEWLAHIWWDDDKYYNPALKSRLTISKDTSKNQVFLKIANVDTADTATYYCARIGADALPFDYWGQGTTLTVSSAKTTPPSVYPLAPGCGDTTGSSVTSGCLVKGYFPEPVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYTLPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 2311 - protein, 460 aa, Artificial Sequence
  Description of Artificial Sequence: Synthetic heavy chain variable domain
MEWSWVSLFFLSVTTGVHSQVQLQQSDAELVKPGASVKISCKVSGYTFTDHIIHWMKQRPEQGLEWIGYIYPRDGYIKYNEKFKGKATLTADKSSSTAYMQVNSLTSEDSAVYFCARGYYYAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 2312 - protein, 458 aa, Artificial Sequence
  Description of Artificial Sequence: Synthetic heavy chain variable domain
MGWSCIIVLLVSTATCVHSQVQLLQPGAELVRPGTSVKLSCKTSGYTFSSYWMHWVKQRPGQGLEWIGMIDPSDVYTNYNPKFKGKATLTVDTSSSTAYMQLSSLTSEDSAVYYCARNYSGDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 2313 - protein, 464 aa, Artificial Sequence
  Description of Artificial Sequence: Synthetic heavy chain variable domain
MGWLWNLLFLMAAAQSAQAQIQLVQSGPELKKPGEAVKISCKSSGYTFTTYGMSWVKQAPGRALKWMGWINTYSGVPTYADDFKGRFAFSLESSASTAYLQINNLKNEDTATYFCARGRDGYQVAWFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 2314 - protein, 458 aa, Artificial Sequence
  Description of Artificial Sequence: Synthetic heavy chain variable domain
MGWSCIIVLLVSTATGVHSQVQLQQPGAELVRPGTSVKLSCKASGYTFTNYWMHWVKQRPGQGLEWIGMIDPSDSYTNYNPKFKGKATLTVDTSSSTAYMQLSSLTSEDSAVYYCARNYSGDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 2315 - protein, 471 aa, Artificial Sequence
  Description of Artificial Sequence: Synthetic heavy chain variable domain
MDMRVPAQLLGLLLLWLRGARCQVQLVESGGGLVKPGGSLRLSCAASGFTFSDYAMSWIRQAPGKGLEWVSTISDGGTYTYYPDSVKGRFTISRDNAKNSLYLQMNSLRAEDTAVYYCAREWGDYDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2316 - protein, 121 aa, Artificial Sequence
  Description of Artificial Sequence: Synthetic heavy chain variable domain
QVQLVQSGAEVKKPGSSVKVSCKASGYTFTDYAMHWVRQAPGQGLEWIGLISIYSDHTNYNQKFQGRATMTVDKSTSTAYMELSSLRSEDTAVYYCGRNNYGNYGWYFDVWGQGTTVTVSS

SEQ ID NO: 2317 - protein, 451 aa, Artificial Sequence
  Description of Artificial Sequence: Synthetic heavy chain variable domain
QVQLVQSGAEVKKPGSSVKVSCKASGYTFTDYAMHWVRQAPGQGLEWIGLISIYSDHTNYNQKFQGRATMTVDKSTSTAYMELSSLRSEDTAVYYCGRNNYGNYGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2318 - protein, 121 aa, Artificial Sequence
  Description of Artificial Sequence: Synthetic heavy chain variable domain
QVQLQQSGPELVRPGESVKISCMGSGYTFTDYAMHWVKQSHAKSLEWIGLISIYSDHTNYNQKFQGKATMTVDKSSSTAYMELARLTSEDSAIYYCGRNNYGNYGWYFDVWGAGTTVTVSS

SEQ ID NO: 2319 - protein, 448 aa, Artificial Sequence
  Description of Artificial Sequence: Synthetic heavy chain variable domain
QVQLVQSGAEVKKPGSSVKVSCKASHYTFTDYAMHWVRQAPGQGLEWMGLISIYSDHTNYNQKFQGRVTITADKSTSTAYMELSSLRSEDTAVYYCGRNNYGNYGWYFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2320 - protein, 121 aa, Artificial Sequence
  Description of Artificial Sequence: Synthetic heavy chain variable domain
QVQLVQSGAEVKKPGSSVKVSCKASGYTFTDYAMHWVRQAPGQGLEWMGLISIYSDHTNYNQKFQGRVTITADKSTSTAYMELSSLRSEDTAVYYCGRNNYGNYGWYFDVWGQGTTVTVSS

SEQ ID NO: 2321 - protein, 121 aa, Artificial Sequence
  Description of Artificial Sequence: Synthetic heavy chain variable domain
QVQLVQSGVEVKKPGASVKVPCKASGYTFTSYYMHWVRQAPGQGLEWMGIINPSGGSTSYAQKFQGRVTMTRDTSTSTVYMELSSLRSEDTAVYYCARDDFWSGAVGMDVWGQGTTVTVSS

SEQ ID NO: 2322 - protein, 120 aa, Artificial Sequence
  Description of Artificial Sequence: Synthetic heavy chain variable domain
EVQLVQSGVDVKKPGSSVKVSCKASGGTFSSYAISWVRQAPGQGLEWMGGIIPIFGTANYAQKFQGRVTITADESASTAYMELSSLRSEDTAVYYCASGYEGPLWAFDIWGQGTMVTVSS

SEQ ID NO: 2323 - protein, 120 aa, Artificial Sequence
  Description of Artificial Sequence: Synthetic heavy chain variable domain
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGPRGYSYNFDYWGQGTLVTVSS

SEQ ID NO: 2324 - protein, 126 aa, Artificial Sequence
  Description of Artificial Sequence: Synthetic heavy chain variable domain
VQLLESGGGLVGINPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSS

SEQ ID NO: 2325 - protein, 118 aa, Artificial Sequence
  Description of Artificial Sequence: Synthetic heavy chain variable domain
EVTLRESGPALVKPTQTLTLTCTVSGFSLSAYSVNWIRQPPGKALEWLAMIWGDGKIVYNSALKSRLTISKDTSKNQVVLTMTNMDPVDTATYYCAGDGYYPYAMDNWGQGSLVTVSS

SEQ ID NO: 2326 - protein, 119 aa, Artificial Sequence
  Description of Artificial Sequence: Synthetic heavy chain variable domain
QVQLQQPGAELVRPGASVKLSCKASGYTFSNYLMNWVKQRPEQDLDWIGRIDPYDGDIDYNQNFKDKAILTVDKSSSTAYMQLSSLTSEDSAVYYCARGYGTAYGVDYWGQGTSVTVSS

SEQ ID NO: 2327 - protein, 111 aa, Artificial Sequence
  Description of Artificial Sequence: Synthetic heavy chain variable domain
DIVLTQSPASLAVSLGQRATISCRASESVDNYGISFMNWFQQKPGQPPKLLIYAASRQGSGVPARFSGSGSGTDFSLNIHPMEEDDTAMYFCQQSKEVPWTFGGGTKLEIK

SEQ ID NO: 2328 - protein, 120 aa, Artificial Sequence
  Description of Artificial Sequence: Synthetic heavy chain variable domain
QVQLQQSGTELMKPGASVKISCKATGYTVSSYWIDWVKQTPGHGLEWIGEILPGSAINNYNEKFKGKATFTADTSSNTAYMQLSSLTSEDSAVYYCASGDYFDSTFVYYWGQGTTLTVSS

SEQ ID NO: 2329 - protein, 120 aa, Artificial Sequence
  Description of Artificial Sequence: Synthetic heavy chain variable domain
QVQLVQSGAEVKKPGATVKISCKADGYTVSSYWIDWVRQAPGQGLEWMGEILPGSAITNYAEKFQGRVTFTADTSTSTAYMELSSLRSEDTATYYCASGDYFDSTFVYYWGQGTTVTVSS

SEQ ID NO: 2330 - protein, 119 aa, Artificial Sequence
  Description of Artificial Sequence: Synthetic heavy chain variable domain
DVKLVESGGGLVKPGGSLKLSCAASGFTFSIYTMSWVRQTPEKRLEWVATISIGGSYINYPDSVKGRFTISRDNAKNTLYLQMSSLKSEDTAIYYCSREVDGSYAMDYWGQGTSVTVSS

SEQ ID NO: 2331 - protein, 120 aa, Artificial Sequence
  Description of Artificial Sequence: Synthetic heavy chain variable domain
EVQLVQSGAEVKKPGATVKISCKASGYTVSSYWIDWVRQAPGQGLEWMGEILPGSAINNYAEKFQGRVTFTADTSTDTAYMELSSLRSEDTAVYYCASGDYFDSTFVYYWGQGTTVTVSS

SEQ ID NO: 2332 - protein, 120 aa, Artificial Sequence
  Description of Artificial Sequence: Synthetic heavy chain variable domain
QVQLVQSGAEVKKPGATVKISCKASGYTVSSYWIDWVRQAPGQGLEWMGEILPGSAITNYAEKFQGRVTFTADTSTSTAYMELSSLRSEDTAVYYCASGDYFDSTFVYYWGQGTTVTVSS

SEQ ID NO: 2333 - protein, 119 aa, Artificial Sequence
  Description of Artificial Sequence: Synthetic heavy chain variable domain
EVKLVESGGGLVKPGASLKLSCAASGFTFSNYGMSWVRQTSDKRLEWVASISSGGGSTYYPDNVKGRFTISRENAKNTLYLQMSSLKSEDTALYYCARVLPGRWAMDYWGQGSSVTVSS

SEQ ID NO: 2334 - protein, 116 aa, Artificial Sequence
  Description of Artificial Sequence: Synthetic heavy chain variable domain
QVQLQQSGTELVRPGASVKLSCKASGYTFTDYEMHWVKQTPVHGLEWIGAIDPGTGGIAYNQKFKGKATLTADKSSSTAYMELRSLTSEDSAVYYCTLYDYDLAYWGQGTLVTVSA

SEQ ID NO: 2335 - protein, 118 aa, Artificial Sequence
  Description of Artificial Sequence: Synthetic heavy chain variable domain
EVKLVESGGGLVKPGGSLKLSCAASGFTFRTYAMSWVRQTPEKRLEWVASISSRGRIYYPDSVKGRFTISRDNARNILYLQMSSLRSEDTAMYYCARDGDYGSSYDYWGQGTTLTVSS

SEQ ID NO: 2336 - protein, 113 aa, Artificial Sequence
  Description of Artificial Sequence: Synthetic heavy chain variable domain
EVQLQQSGADLVRSGASVKLSCTASGFNIKDYYIHWVKQRPEQGLELIGWIDPESGDTEYAPKFQVKATMTADTSSNTAYLQLSSLTSEDTAVYYCNDGSGYWGQGTTLTVSS

SEQ ID NO: 2337 - protein, 112 aa, Artificial Sequence
  Description of Artificial Sequence: Synthetic heavy chain variable domain
DVVMTQTPLTLSVTLGQPASISCKSSQSLLDSDGETYLNWLLQRPGQSPKRLISLVSKLDSGVPDRFTGSGSGTDFTLKISRVEAEDLGVYYCWQGTHFPYTFGGGTKLEIK

SEQ ID NO: 2338 - protein, 121 aa, Artificial Sequence
  Description of Artificial Sequence: Synthetic heavy chain variable domain
EVKLEESGGGLVQPGGSMKLSCVASGFTFSNYWMNWVRQSPEKGLEWMAEITLKFNNYSTHYAESVKGRFSISRDDSKSTVYLQMNNLRAEDTGIYYCARRNYGDWYINVWGAGTTVTVSS

SEQ ID NO: 2339 - protein, 121 aa, Artificial Sequence
  Description of Artificial Sequence: Synthetic heavy chain variable domain
EVQLVESGGGLVQPGGSLRLSCAASGFTFSNYWMNWVRQAPGKGLEWMAEITLKFNNYSTHYAESVKGRFTISRDNSKNTVYLQMNSLRAEDTAVYYCARRNYGNWYINVWGQGTLVTVSS

SEQ ID NO: 2340 - protein, 121 aa, Artificial Sequence
  Description of Artificial Sequence: Synthetic heavy chain variable domain
EVQLVESGGGLVQPGGSLRLSCAASGFTFSNYWMNWVRQAPGKGLEWMAEITLKFNDYSTHYAESVKGRFTISRDNSKNTVYLQMNSLRAEDTAVYYCARRNYGNWYINVWGQGTLVTVSS

SEQ ID NO: 2341 - protein, 121 aa, Artificial Sequence
  Description of Artificial Sequence: Synthetic heavy chain variable domain
EVKLEESGGGLVQPGGSMKLSCVASGFTFNKFWMNWVRQSPEKGLEWVAEIRLNSINYVKDYAESVKGRFTISRDDSKNSVYLQMNNLRAEDTGIYYCIRRNYGNWFFEIWGAGTTVTVSS

SEQ ID NO: 2342 - protein, 121 aa, Artificial Sequence
  Description of Artificial Sequence: Synthetic heavy chain variable domain
EVQLVESGGGLVQPGGSLRLSCAASGFTFNKFWMNWVRQAPGKGLEWVAEIRLNSINYVKDYAESVKGRFTISRDNAKNSVYLQMNSLRAEDTAVYYCIRRNYGNWFFEIWGQGTLVTVSS

SEQ ID NO: 2343 - protein, 121 aa, Artificial Sequence
  Description of Artificial Sequence: Synthetic heavy chain variable domain
EVQLVESGGGLVQPGGSLRLSCAASGFTFNKFWMNWVRQAPGKGLEWVAEIRLSSINYVKDYAESVKGRFTISRDNAKNSVYLQMNSLRAEDTAVYYCIRRNYGNWFFEIWGQGTLVTVSS

SEQ ID NO: 2344 - protein, 121 aa, Artificial Sequence
  Description of Artificial Sequence: Synthetic heavy chain variable domain
EVQLVESGGGLVQPGGSLRLSCAASGFTFNKFWMNWVRQAPGKGLEWVAEIRLNAINYVKDYAESVKGRFTISRDNAKNSVYLQMNSLRAEDTAVYYCIRRNYGNWFFEIWGQGTLVTVSS

SEQ ID NO: 2345 - protein, 122 aa, Artificial Sequence
  Description of Artificial Sequence: Synthetic heavy chain variable domain
EVLLQQSGPELVKPGASVKISCNASGYTFSDYNMNWVKQSHGKSLESIGDINPKNGDTFYNQNFKDKATLTIDKSSSTVYMELRSLTSEDTAMYYCARHYYYGSSYGGFVYWGQGTLVTVAA

SEQ ID NO: 2346 - protein, 122 aa, Artificial Sequence
  Description of Artificial Sequence: Synthetic heavy chain variable domain
EVQLVQSGAEVKKPGASVKVSCKASGYTFSDYNMNWVRQAPGQGLESIGDINPKNGDTFYNQNFKDRATLTIDKSTSTAYLELSSLRSEDTAVYYCARHYYYGSSYGGFVYWGQGTLVTVSS

SEQ ID NO: 2347 - protein, 122 aa, Artificial Sequence
  Description of Artificial Sequence: Synthetic heavy chain variable domain
EVQLVQSGAEVKKPGASVKVSCKASGYTFSDYNMNWVRQAPGQGLESIGDINPKSGDTFYNQNFKDRATLTIDKSTSTAYLELSSLRSEDTAVYYCARHYYYGSSYGGFVYWGQGTLVTVSS

SEQ ID NO: 2348 - protein, 122 aa, Artificial Sequence
  Description of Artificial Sequence: Synthetic heavy chain variable domain
EVQLVQSGAEVKKPGASVKVSCKASGYTFSDYNMNWVRQAPGQGLESIGDINPKNADTFYNQNFKDRATLTIDKSTSTAYLELSSLRSEDTAVYYCARHYYYGSSYGGFVYWGQGTLVTVSS

SEQ ID NO: 2349 - protein, 122 aa, Artificial Sequence
  Description of Artificial Sequence: Synthetic heavy chain variable domain
QVQLQQSGNDLVKPGASVKLSCKASGYTFTSYWINWIKQRPGQGLEWIGRIAPGSGFISYNELFKDKATLTVDTSSSTAYIQLGSLSSEDSAVYFCAREFYYGSFYGGFAYWGQGTLVTVSA

SEQ ID NO: 2350 - protein, 122 aa, Artificial Sequence
  Description of Artificial Sequence: Synthetic heavy chain variable domain
EVQLVQSGAEVKKPGASVKVSCKASGYTFTSYWINWVRQAPGQGLEWIGRIAPGSGFISYNELFKDRVTITRDTSTSTAYLELSSLRSEDTAVYYCAREFYYGSFYGGFAYWGQGTLVTVSS

SEQ ID NO: 2351 - protein, 119 aa, Artificial Sequence
  Description of Artificial Sequence: Synthetic heavy chain variable domain
QVQLVQSGGGLVQPGGSLKLSCAASGFTFSGSAMHWVRQASGKGLEWVGRIRSRNNNYATAYAASVKGRFTISRDDSKRTTYLQMNSLKTEDTAVYYCTRLQQPPFDYWGQGTLVTVSS

SEQ ID NO: 2352 - protein, 119 aa, Artificial Sequence
  Description of Artificial Sequence: Synthetic heavy chain variable domain
EVQLVESGGDLVQPGGSLKLSCAASGFTFSGSAIHWVRQASGKGLEWVGRIRSRTNNYATEYDASVKGRFTISRDDSKRTAYLQMNSLKTEDTAVYYCTRLGQPPFDYWGQGTLVTVSS

SEQ ID NO: 2353 - protein, 119 aa, Artificial Sequence
  Description of Artificial Sequence: Synthetic heavy chain variable domain
EVQLVESGGGLVQPGGSLKLSCAASGFTFSGSAMHWVRQAPGKGLEWVGRIRSKGNSYATAYAASVKGRFSISRDDSKRTAYLQMSSLKTEDSAVYYCARQFGDPFDYWGQGTLVTVSS

SEQ ID NO: 2354 - protein, 119 aa, Artificial Sequence
  Description of Artificial Sequence: Synthetic heavy chain variable domain
EVQLVESGGGLVQPGGSLRLSCAASGFTFSSFSMSWVRQAPGKGLEWVATISGGKTFTDYVDSVKGRFTISRDDSKNTLYLQMNSLRAEDTAVYYCTRANYGNWFFEVWGQGTLVTVSS

SEQ ID NO: 2355 - protein, 119 aa, Artificial Sequence
  Description of Artificial Sequence: Synthetic heavy chain variable domain
DVNLVESGGGSVKPGGSLKLSCVASGFTFSSFSMSWVRQTPEKRLEWVATISGGKTFTDYVDSVKGRFTISRDDAKNTLYLQMSSLESEDTAMYYCTRANYGNWFFEVWGAGTTVAVSS

SEQ ID NO: 2356 - protein, 119 aa, Artificial Sequence
  Description of Artificial Sequence: Synthetic heavy chain variable domain
EVQLVESGGGLVQPGGSLRLSCAASGFTFSSFSMSWVRQAPGKGLEWVATISGGKTFTDYVDSVKGRFTISRDNSKNTLYLQMNSLRAEDTAVYYCTRANYGNWFFEVWGQGTLVTVSS

SEQ ID NO: 2357 - protein, 128 aa, Artificial Sequence
  Description of Artificial Sequence: Synthetic heavy chain variable domain
ELQLQESGPGLVKPSETLSLTCTVSGGSIRSSIFYWGWIRQPPGKGLEWIGSIYYSGRTYYNPSLKSRVTISVDTSKNQFSLMLTSVTAADTAVYYCARAGGLYNWNDESFSFYMDVWGQGTTVTVSS

SEQ ID NO: 2358 - protein, 128 aa, Artificial Sequence
  Description of Artificial Sequence: Synthetic heavy chain variable domain
ELQLQESGPGLVKPSETLSLTCTVSGGSIRSSIFYWGWIRQPPGKGLEWIGSIYYSGRTYYNPALKSRVTISVDTSKNQFSLMLTSVTAADTAVYYCARAGGLYNWNDESFSFYMDVWGQGTTVTVSS

SEQ ID NO: 2359 - protein, 128 aa, Artificial Sequence
  Description of Artificial Sequence: Synthetic heavy chain variable domain
QLQLQESGPGLVKPSETLSLTCTVSGGSIRSSIFYWGWIRQPPGKGLEWIGSIYYSGRTYYNPSLKSRVTISVDTSKNQFSLMLTSVTAADTAVYYCARAGGLYNWNDESFSFYMDVWGNGTTVTVSS

SEQ ID NO: 2360 - protein, 112 aa, Artificial Sequence
  Description of Artificial Sequence: Synthetic heavy chain variable domain
QIQLVQSGPELKKPGETVKISCKTSGYVFTNYGMNWVKQAPGKGFKWMGWMNTNTGEPTSLEDFKGRFAFSLETSASTAYLQINNLKNDDTATYFCARSGGYDPMDYWGQGT

SEQ ID NO: 2361 - protein, 121 aa, Artificial Sequence
  Description of Artificial Sequence: Synthetic heavy chain variable domain
EVQLVQSGAEVKKPGATVKISCKVSGFNIKDTYMHWVQQAPGKGLEWMGRIDPASGDTKYDPKFQVRVTITADTSTDTAYMELSSLRSEDTAVYYCATGMWVSTGYALDFWGQGTLVTVSS

SEQ ID NO: 2362 - protein, 121 aa, Artificial Sequence
  Description of Artificial Sequence: Synthetic heavy chain variable domain
EVQLVQSGAEVKKPGATVKISCKASGFNIKDTYMHWVQQAPGKGLEWMGRIDPASGDTKYDPKFQVRVTITADTSTDTAYMELSSLRSEDTAVYYCADGMWVSTGYALDFWGQGTLVTVSS

SEQ ID NO: 2363 - protein, 121 aa, Artificial Sequence
  Description of Artificial Sequence: Synthetic heavy chain variable domain
EVQLVQSGAEVKKPGATVKISCKASGFNIKDTYMHWVQQAPGKGLEWIGRIDPASGDTKYDPKFQVRATITADTSTNTAYLELSSLRSEDTAVYYCADGMWVSTGYALDFWGQGTLVTVSS

SEQ ID NO: 2364 - protein, 125 aa, Artificial Sequence
  Description of Artificial Sequence: Synthetic heavy chain variable domain
EVQLVQSGAEVKKPGASVKVSCKASGGTFSSYAISWVRQAPGQGLEWMGGIIPIFGTANYAQKFQGRVTFTADKSTSTAYMELRSLRSDDTAVYYCARGYDYYDSSGVASPFDYWGQGTLVTVSS

SEQ ID NO: 2365 - protein, 116 aa, Artificial Sequence [sequence omitted]

SEQ ID NO: 2366 - protein, 107 aa, Artificial Sequence
  Description of Artificial Sequence: Synthetic heavy chain variable domain
EIVMTQSPATLSLSPGERATLSCRASQSVSSYLAWYQQKPGQAPRLLIYDSSNRATGIPARFSGSGSGTDFTLTISSLEPEDFATYYCLQHNTFPPTFGQGTKVEIK

SEQ ID NO: 2367 - protein, 110 aa, Artificial Sequence
  Description of Artificial Sequence: Synthetic heavy chain variable domain
QSALTQPASLSGSPGQSITISCAGTTTDLTYYDLVSWYQQHPGQAPKLVIYDGNKRPSGVSNRFSGSKSGNTASLTISGLQAEDEADYYCNSYVSSRFYVFGTGTKVTVL

SEQ ID NO: 2368 - protein, 116 aa, Artificial Sequence
  Description of Artificial Sequence: Synthetic heavy chain variable domain
EVQLVQSGGGLVKPGGSLRLSCAASGFTFSSYSMNWVRQAPGKGLEWVSSISSSSSYIYYADSVKGRFTISRDNAKDSLYLQMNSLRAEDTAVYYCARVTDAFDIWGQGTMVTVSS

SEQ ID NO: 2369 - protein, 107 aa, Artificial Sequence
  Description of Artificial Sequence: Synthetic heavy chain variable domain
DIQLTQSPSSVSASVGDRVTITCRASQGISSRLAWYQQKPGKAPKLLIYAASSLQTGVPSRFSGSGSGTDFTLTISSLQPEDFATYYCQQANRFPPTFGPGTKVDIK

SEQ ID NO: 2370 - protein, 123 aa, Artificial Sequence
  Description of Artificial Sequence: Synthetic heavy chain variable domain
QVQLVQSGAEVKKPGSSVKVSCKASGGTFSFYAISWVRQAPGQGLEWMGGFIPIFGAANYAQKFQGRVTITADESTSTAYMELSSLRSDDTAVYYCARIPSGSYYYDYDMDVWGQGTTVTVSS

SEQ ID NO: 2371 - protein, 450 aa, Artificial Sequence
  Description of Artificial Sequence: Synthetic heavy chain variable domain
QVQLVQSGAEVKKPGSSVKVSCKASGGTFSFYAISWVRQAPGQGLEWMGGFIPIFGAANYAQKFQGRVTITADESTSTAYMELSSLRSDDTAVYYCARIPSGSYYYDYDMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2372 - protein, 123 aa, Artificial Sequence; identical to SEQ ID NO: 2370
  Description of Artificial Sequence: Synthetic heavy chain variable domain

SEQ ID NO: 2373 - protein, 113 aa, Artificial Sequence
  Description of Artificial Sequence: Synthetic heavy chain variable domain
MADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKR

SEQ ID NO: 2374 - protein, 125 aa, Artificial Sequence
  Description of Artificial Sequence: Synthetic heavy chain variable domain
EVQLQQSGAELVKPGASVKLSCTASGFNIKDTYMHWVKQRPEQGLEWIGRIDPANGNTKYDPKFQGKATIIADTSSNTAYLQLSSLTSEDTAVYYCARGVYHDYDGDYWGQGTTLTVSSYVTVSS

SEQ ID NO: 2375 - protein, 125 aa, Artificial Sequence
  Description of Artificial Sequence: Synthetic heavy chain variable domain
EVQLVQSGAEVKKPGATVKISCKVSGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSS

SEQ ID NO: 2376 - protein, 125 aa, Artificial Sequence
  Description of Artificial Sequence: Synthetic heavy chain variable domain
QVQLVQSGAEVKKPGASVKVSCKASGFTLTNYGMNWVRQARGQRLEWIGWINTDTGEPTYADDFKGRFVFSLDTSVSTAYLQISSLKAEDTAVYYCARNPPYYYGTNNAEAMDYWGQGTTVTVSS

SEQ ID NO: 2377 - protein, 125 aa, Artificial Sequence
  Description of Artificial Sequence: Synthetic heavy chain variable domain
QVQLVQSGAEVKKPGASVKVSCKASGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSS

SEQ ID NO: 2378 - protein, 125 aa, Artificial Sequence
  Description of Artificial Sequence: Synthetic heavy chain variable domain
EVQLVQSGAEVKKPGATVKISCKVSGFTLTNYGMNWVRQAPGQGLEWMGWINTDTGEPTYADDFKGRFVFSLDTSVSTAYLQICSLKAEDTAVYYCARNPPYYYGTNNAEAMDYWGQGTTVTVSS

SEQ ID NO: 2379 - protein, 125 aa, Artificial Sequence
  Description of Artificial Sequence: Synthetic heavy chain variable domain
QVQLVQSGAEVKKPGASVKVSCKASGFTLTNYGMNWVRQARGQRLEWIGWINTDTGEPTYADDFKGRFVFSLDTSVSTAYLQICSLKAEDTAVYYCARNPPYYYGTNNAEAMDYWGQGTTVTVSS

SEQ ID NO: 2380 - protein, 125 aa, Artificial Sequence
  Description of Artificial Sequence: Synthetic heavy chain variable domain
QVQLVQSGAEVKKPGASVKVSCKASGFTLTNYGMNWVRQAPGQGLEWMGWINTDTGEPTYADDFKGRFVFSLDTSVSTAYLQICSLKAEDTAVYYCARNPPYYYGTNNAEAMDYWGQGTTVTVSS

SEQ ID NO: 2381 - protein, 125 aa, Artificial Sequence
  Description of Artificial Sequence: Synthetic heavy chain variable domain
EVQLVQSGAEVKKPGATVKISCKVSGFTLTNYGMNWIRQSPSRGLEWLGWINTDTGEPTYADDFKGRFVFSLDTSVSTAYLQICSLKAEDTAVYYCARNPPYYYGTNNAEAMDYWGQGTTVTVSS

SEQ ID NO: 2382 - protein, 125 aa, Artificial Sequence
  Description of Artificial Sequence: Synthetic heavy chain variable domain
EVQLVQSGAEVKKPGESLRISCKGSGFTLTNYGMNWVRQATGQGLEWMGWINTDTGEPTYADDFKGRVTISADKSISTAYLQWSSLKASDTAMYYCARNPPYYYGTNNAEAMDYWGQGTTVTVSS

SEQ ID NO: 2383 - protein, 125 aa, Artificial Sequence
  Description of Artificial Sequence: Synthetic heavy chain variable domain
EVQLVQSGAEVKKPGATVKISCKVSGFTLTNYGMNWIRQSPSRGLEWLGWINTDTGEPTYADDFKGRFVFSLDTSVSTAYLQISSLKAEDTAVYYCARNPPYYYGTNNAEAMDYWGQGTTVTVSS

SEQ ID NO: 2384 - protein, 125 aa, Artificial Sequence
  Description of Artificial Sequence: Synthetic heavy chain variable domain
QVQLVQSGSELKKPGASVKVSCKASGFTLTNYGMNWVRQAPGQGLEWMGWINTDTGEPTYADDFKGRFVFSLDTSVSTAYLQISTLKAEDTATYFCARNPPYYYGTNNAEAMDYWGQGTTVTVSS

SEQ ID NO: 2385 - protein, 447 aa, Artificial Sequence
  Description of Artificial Sequence: Synthetic heavy chain variable domain
QVQLQQWGAGLLKPSETLSLTCAVYGGSFSDYYWNWIRQPPGKGLEWIGEINHRGSTNSNPSLKSRVTLSLDTSKNQFSLKLRSVTAADTAVYYCAFGYSDYEYNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2386 - protein, 107 aa, Artificial Sequence
  Description of Artificial Sequence: Synthetic heavy chain variable domain
EVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSS

SEQ ID NO: 2387 - protein, 161 aa, Artificial Sequence
  Description of Artificial Sequence: Synthetic heavy chain variable domain
LPEFEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSPAWFVYWGQGTLVTLSAAKTTAPSVYPLAPVCGDTTGSSVTLGCLVKRSS

SEQ ID NO: 2388 - protein, 119 aa, Artificial Sequence
  Description of Artificial Sequence: Synthetic heavy chain variable domain
QVQLVQSGAEVKKPGASVKVSCKASGYTFTSNFMHWVRQAPGQGLEWIGWIYPGDGDTEYNQKFNGKVTMTRDTSTSTVYMELSSLRSEDTAVYYCARGNSGYNWFAYWGQGTTVTVSS

SEQ ID NO: 2389 - protein, 119 aa, Artificial Sequence
  Description of Artificial Sequence: Synthetic heavy chain variable domain
EVQLVQSGAEVKKPGESLKISCKGSGYTFTSNFMHWVRQMPGKGLEWIGWIYPGDGDTEYNQKFNGKVTISADKSISTAYLQWSSLKASDTAMYYCARGNSGYNWFAYWGQGTTVTVSS

SEQ ID NO: 2390 - protein, 119 aa, Artificial Sequence
  Description of Artificial Sequence: Synthetic heavy chain variable domain
QVQLQQSGAELVKPGSSVKISCKASGYTFTSYFIHWIKQQPGNGLEWIGWIYPGDGDTEYNQKFNGKATFIADKSSSTADMQLNSLTSEDSAVYFCARSKSAYNWFAYWGQGTLVTVSS

SEQ ID NO: 2391 - protein, 119 aa, Artificial Sequence
  Description of Artificial Sequence: Synthetic heavy chain variable domain
QVQLQQSGAELVKPGSSVKISCKASGYTFTSNFMHWIKQQPGNGPEWIGWIYPGDGDTEYNQKFNGKATLIADKSSTTAYMQLRSLTSEDSAVYFCARGNSGYNWFAYWGQGTLVTVSS

SEQ ID NO: 2392 - protein, 118 aa, Artificial Sequence
  Description of Artificial Sequence: Synthetic heavy chain variable domain
EVQLVQSGAEVKKPGASVKVSCKASGYTFSAYWIEWVRQAPGQGLEWIGEILPGSDSTDYNEKFKVRVTITSDTSTSTVYLELSSLRSEDTAVYYCARGGHYGSLDYWGQGTLVTVSS

SEQ ID NO: 2393 - protein, 118 aa, Artificial Sequence
  Description of Artificial Sequence: Synthetic heavy chain variable domain
EVQLVQSGAEVKKPGASVKVSCKASGYTFSAYWIEWVRQAPGQGLEWIGEILPGSDSTDYNEKFKVRATFTSDTSTSTVYLELSSLRSEDTAVYYCARGGHYGSLDYWGQGTLVTVSS

SEQ ID NO: 2394 - protein, 118 aa, Artificial Sequence
  Description of Artificial Sequence: Synthetic heavy chain variable domain
EVQLVQSGAEVKKPGASVKVSCKASGYTFSAYWIEWVRQAPGQGLEWIGEILPGSDSTDYNEKFKVRVTITADTSTSTAYLELSSLRSEDTAVYYCARGGHYGSLDYWGQGTLVTVSS

SEQ ID NO: 2395 - protein, 118 aa, Artificial Sequence
  Description of Artificial Sequence: Synthetic heavy chain variable domain
EVQLVQSGAEVKKPGASVKVSCKASGYTFSAYWIEWVRQAPGQGLEWIGEILPGSDSTDYNEKFKVRVTITRDTSTSTAYLELSSLRSEDTAVYYCARGGHYGSLDYWGQGTLVTVSS

SEQ ID NO: 2396 - protein, 118 aa, Artificial Sequence; identical to SEQ ID NO: 2394
  Description of Artificial Sequence: Synthetic heavy chain variable domain

SEQ ID NO: 2397 - protein, 115 aa, Artificial Sequence
  Description of Artificial Sequence: Synthetic heavy chain variable domain
QVQLQQPGAEMVKPGASVKLSCKASVDTFNSYWMHWVKQRPGQGLEWIGEINPSNGRTNYIEKFKNRATVTVDKSSSTAFMQLSSLTSEDSAVYYCATGWYFDVWGAGTTVTVSS

SEQ ID NO: 2398 - protein, 121 aa, Artificial Sequence
  Description of Artificial Sequence: Synthetic heavy chain variable domain
EVQLQQSGPELVKPGTSMKISCKASGYSFTGYTMNWVKQSHKNGLEWIGLINCYNGGTNYNQKFKGKATLTVDKSSSTAFMELLSLTSEDSAVYYCARGGSTMITPRFAYWGQGTLVTVSS

SEQ ID NO: 2399 - protein, 116 aa, Artificial Sequence
  Description of Artificial Sequence: Synthetic heavy chain variable domain
EVQLVESGGGLVQPGGSLRLSCAASGFTFTSYSISWVRQAPGKGLEWVAEIYPPGGYTDYADSVKGRFTISADTSKNTAYLQMNSLRAEDTAVYYCAKARLFFDYWGQGTLVTVSS

SEQ ID NO: 2400 - protein, 118 aa, Artificial Sequence
  Description of Artificial Sequence: Synthetic heavy chain variable domain
QVQLQQSGTELMKPGASVKISCKATGYTFSAYWIEWIKQRPGHGLEWIGEILPGSDSTDYNEKFKVKATFSSDTSSNTVYIQLNSLTYEDSAVYYCARGGHYGSLDYWGQGTTLKVSS

SEQ ID NO: 2401 - protein, 113 aa, Artificial Sequence
  Description of Artificial Sequence: Synthetic heavy chain variable domain
EVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSS

SEQ ID NO: 2402 - protein, 115 aa, Artificial Sequence
  Description of Artificial Sequence: Synthetic heavy chain variable domain
QVQLKESGPGLVAPSQSLSRRCTVSGFSLTTYGVSWVRQPPGKGLEWLGVIWGDGSTYYHSALISRLSISKDNSKSQVFLKLNSLQTDDTATYYCAEGSSLFAYWGQGTLVTVSA

SEQ ID NO: 2403 - protein, 103 aa, Artificial Sequence
  Description of Artificial Sequence: Synthetic heavy chain variable domain
EVQLEQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLL

SEQ ID NO: 2404 - protein, 121 aa, Artificial Sequence
  Description of Artificial Sequence: Synthetic heavy chain variable domain
QVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSS

SEQ ID NO: 2405 - protein, 106 aa, Artificial Sequence
  Description of Artificial Sequence: Synthetic heavy chain variable domain
DIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIK

SEQ ID NO: 2406 - protein, 113 aa, Artificial Sequence
  Description of Artificial Sequence: Synthetic heavy chain variable domain
  MOD_RES (89)..(89): Any amino acid
DIVMTQSPSSLTVTAGEKVTMSCKSSQSLLNSGNQKNYLTWYQQKPGQPPKLLIYWASTRQSGVPDRFTGSGSGTDFTLTISSVQAEDXAVYYCQNDYSYPLTFGSGTKLEIK

SEQ ID NO: 2407 - protein, 107 aa, Artificial Sequence
  Description of Artificial Sequence: Synthetic heavy chain variable domain
DIVLTQTPSSLSASLGDTITITCHASQNINVWLFWYQQKPGNIPKLLIYKASNLLTGVPSRFSGSGSGTGFTLTISSLQPEDIATYYCQQGQSFPWTFGGGTKLEIK

SEQ ID NO: 2408 - protein, 107 aa, Artificial Sequence
  Description of Artificial Sequence: Synthetic heavy chain variable domain
DIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIK

SEQ ID NO: 2409 - protein, 119 aa, Artificial Sequence
  Description of Artificial Sequence: Synthetic heavy chain variable domain
EVQLVESGGGLVQPKGSLKLSCAASGFTFNTNAMNWVRQAPGKGLEWVARIRSKSNNYATYYADSVKDRFTLSRDDSQSMLYLQMNNLKTEDTAMYYCVRDRGWGAMDYWGQGTTVTVS

SEQ ID NO: 2410 - protein, 119 aa, Artificial Sequence
  Description of Artificial Sequence: Synthetic heavy chain variable domain
GVQLVETGGGLVQPKGSLKLSCAASGFTFNTNAMNWVRQAPGKGLEWVARIRSKSNNYATYYADSVKDRFTLSRDDSQSMLYLQMNNLKTEDTAMYYCVRDRGWGAMDYWGQGTTVTVS

SEQ ID NO: 2411 - protein, 120 aa, Artificial Sequence
  Description of Artificial Sequence: Synthetic heavy chain variable domain
EVQLVESGGGLVKPGGSLRLSCAASGFTFNTNAMNWVRQAPGKGLEWVARIRSKSNNYATYYADSVKDRFTLSRDDSKNTLYLQMNSLKTEDTAVYYCTRDRGWGAMDYWGQGTTVTVSS

SEQ ID NO: 2412 - protein, 120 aa, Artificial Sequence
  Description of Artificial Sequence: Synthetic heavy chain variable domain
EVQLVESGGGLVKPGGSLRLSCAASGFTFNTNAMNWVRQAPGKGLEWVARIRSKSNNYATYYADSVKDRFTISRDDSKNTLYLQMNSLKTEDTAVYYCTRDRGWGAMDYWGQGTTVTVSS

SEQ ID NO: 2413 - protein, 119 aa, Artificial Sequence
  Description of Artificial Sequence: Synthetic heavy chain variable domain
EVQLVETGGGLVQPKGSLKLSCAASGFTFNTNAMNWVRQAPGKGLEWVARIRSKSNNYATYYADSVKDRFTLSRDDSQSMLYLQMNNLKTEDTAMYYCVRDRGWGAMDYWGQGTTVTVS

SEQ ID NO: 2414 - protein, 116 aa, Artificial Sequence
  Description of Artificial Sequence: Synthetic heavy chain variable domain
QVQLVQSGAEVKKPGSSVKVSCKASGYTFTTYYLHWVRQAPGQGLEWIGWIYPGNVHAQYNEKFKGRATLTADKSTSTAYMELSSLRSEDTAVYFCARSWEGFPYWGQGTTVTVSS

SEQ ID NO: 2415 - protein, 116 aa, Artificial Sequence
  Description of Artificial Sequence: Synthetic heavy chain variable domain
QVQLVQSGAEVKKPGSSVKVSCKASGYTFTTYYLHWVRQAPGQGLEWIGWIYPGNVHAQYNEKFKGRATITADKSTSTAYMELSSLRSEDTAVYYCARSWEGFPYWGQGTTVTVSS

SEQ ID NO: 2416 - protein, 116 aa, Artificial Sequence
  Description of Artificial Sequence: Synthetic heavy chain variable domain
QVQLVQSGAEVKKPGSSVKVSCKASGYTFTTYYLHWVRQAPGQGLEWMGWIYPGNVHAQYNEKFKGRVTITADKSTSTAYMELSSLRSEDTAVYYCARSWEGFPYWGQGTTVTVSS

SEQ ID NO: 2417 - protein, 445 aa, Artificial Sequence
  Description of Artificial Sequence: Synthetic heavy chain variable domain
QVQLVQSGAEVKKPGSSVKVSCKASGYTFTTYYLHWVRQAPGQGLEWMGWIYPGNVHAQYNEKFKGRVTITADKSTSTAYMELSSLRSEDTAVYYCARSWEGFPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2418 - protein, 112 aa, Artificial Sequence
  Description of Artificial Sequence: Synthetic heavy chain variable domain
VQLQQSGPELVKPGASVRISCKASGYTFTTYYLHVKQRPGQGLEIGWIYPGVHAQYNEKFKGKATLTADKSSSTAYMQLSSLTSEDSAIYFCARSWEGFPYWGQGTTVTVSS

SEQ ID NO: 2419 - protein, 135 aa, Artificial Sequence
  Description of Artificial Sequence: Synthetic heavy chain variable domain
MEWSRVFIFLLSVTAGVHSQVQLQQSGAELVRPGTSVKVSCKASGYAFTYYLIEWVKQRPGQGLEWIGVINPGSGGTNYNEKFKGKATLTADKSSSTAYMQLSSLTSDDSAVYFCARNWMNFDYWGQGTTLTVSS

SEQ ID NO: 2420 - protein, 462 aa, Artificial Sequence
  Description of Artificial Sequence: Synthetic heavy chain variable domain
MGWSLILLFLVAVATRVHSQVQLVQSGAEVKKPGASVKVSCKASGYAFTYYLIEWVRQAPGQGLEWIGVINPGSGGTNYNEKFKGRATITADKSTSTAYMELSSLRSEDTAVYFCARNWMNFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2421 - protein, 121 aa, Artificial Sequence
  Description of Artificial Sequence: Synthetic heavy chain variable domain
QVQLKESGPGLVAPSQSLSITCTVSGFSLSRYSVHWVRQPPGKGLEWLGMIWGGGSTDYNSALKSRLSISKDNSKSQVFLKMNSLQTDDTAMYYCARNEGDTTAGTWFAYWGQGTLVTVSA

SEQ ID NO: 2422 - protein, 118 aa, Artificial Sequence
  Description of Artificial Sequence: Synthetic heavy chain variable domain
QVTLKESGPVLVKPTETLTLTCTVSGFSLTSNGVSWVRQPPGKALEWIAAISSGGTTYYNSAFKSRLTISRDTSKSQVVLTMTNMDPVDTATYYCARRYGYGWYFDFWGQGTLVTVSS

SEQ ID NO: 2423 - protein, 118 aa, Artificial Sequence
  Description of Artificial Sequence: Synthetic heavy chain variable domain
QVTLKESGPVLVKPTETLTLTCTVSGFSLTSNGVSWVRQPPGKALEWIAAISSGGTTYYNSAFKSRLSISRDTSKSQVVLTMTNMDPVDTATYYCARRYGYGWYFDFWGQGTLVTVSS

SEQ ID NO: 2424 - protein, 118 aa, Artificial Sequence
  Description of Artificial Sequence: Synthetic heavy chain variable domain
QVTLKESGPVLVKPTETLTLTCTVSGFSLTSSGVSWVRQPPGKALEWIAAISSGGTTYYNSAFKSRLTISRDTSKSQVVLTMTNMDPVDTATYYCARRYGYGWYFDFWGQGTLVTVSS

SEQ ID NO: 2425 - protein, 118 aa, Artificial Sequence
  Description of Artificial Sequence: Synthetic heavy chain variable domain
QVTLKESGPVLVKPTETLTLTCTVSGFSLTSQGVSWVRQPPGKALEWIAAISSGGTTYYNSAFKSRLTISRDTSKSQVVLTMTNMDPVDTATYYCARRYGYGWYFDFWGQGTLVTVSS

SEQ ID NO: 2426 - protein, 118 aa, Artificial Sequence
  Description of Artificial Sequence: Synthetic heavy chain variable domain
QVTLKESGPVLVKPTETLTLTCTVSGFSLTSNAVSWVRQPPGKALEWIAAISSGGTTYYNSAFKSRLTISRDTSKSQVVLTMTNMDPVDTATYYCARRYGYGWYFDFWGQGTLVTVSS

SEQ ID NO: 2427 - protein, 118 aa, Artificial Sequence
  Description of Artificial Sequence: Synthetic heavy chain variable domain
EVTLKESGPVLVKPTETLTLTCTVSGFSLTSNGVSWVRQPPGKALEWIAAISSGGTTYYNSAFKSRLTISRDTSKSQVVLTMTNMDPVDTATYYCARRYGYGWYFDFWGQGTLVTVSS

SEQ ID NO: 2428 - protein, 118 aa, Artificial Sequence
  Description of Artificial Sequence: Synthetic heavy chain variable domain
EVTLKESGPVLVKPTETLTLTCTVSGFSLTSNGVSWVRQPPGKALEWIAAISSGGTTYYNSAFKSRLSISRDTSKSQVVLTMTNMDPVDTATYYCARRYGYGWYFDFWGQGTLVTVSS

SEQ ID NO: 2429 - protein, 118 aa, Artificial Sequence
  Description of Artificial Sequence: Synthetic heavy chain variable domain
EVTLKESGPVLVKPTETLTLTCTVSGFSLTSSGVSWVRQPPGKALEWIAAISSGGTTYYNSAFKSRLTISRDTSKSQVVLTMTNMDPVDTATYYCARRYGYGWYFDFWGQGTLVTVSS

SEQ ID NO: 2430 - protein, 118 aa, Artificial Sequence
  Description of Artificial Sequence: Synthetic heavy chain variable domain
EVTLKESGPVLVKPTETLTLTCTVSGFSLTSQGVSWVRQPPGKALEWIAAISSGGTTYYNSAFKSRLTISRDTSKSQVVLTMTNMDPVDTATYYCARRYGYGWYFDFWGQGTLVTVSS

SEQ ID NO: 2431 - protein, 118 aa, Artificial Sequence
  Description of Artificial Sequence: Synthetic heavy chain variable domain
EVTLKESGPVLVKPTETLTLTCTVSGFSLTSNAVSWVRQPPGKALEWIAAISSGGTTYYNSAFKSRLTISRDTSKSQVVLTMTNMDPVDTATYYCARRYGYGWYFDFWGQGTLVTVSS

SEQ ID NO: 2432 - protein, 116 aa, Artificial Sequence
  Description of Artificial Sequence: Synthetic heavy chain variable domain
QVTLKESGPVLVKPTETLTLTCTVSGFSLTSSGVSWVRQPPGKALEWIAAISSGGSTYYNSAFKSRLTISRDTSKSQVVLTMTNMDPVDTATYYCARHRPFYFDYWGQGTLVTVSS

SEQ ID NO: 2433 - protein, 116 aa, Artificial Sequence
  Description of Artificial Sequence: Synthetic heavy chain variable domain
QVTLKESGPVLVKPTETLTLTCTVSGFSLTSQGVSWVRQPPGKALEWIAAISSGGSTYYNSAFKSRLTISRDTSKSQVVLTMTNMDPVDTATYYCARHRPFYFDYWGQGTLVTVSS

SEQ ID NO: 2434 - protein, 121 aa, Artificial Sequence
  Description of Artificial Sequence: Synthetic heavy chain variable domain
QIQLVQSGPELKKPGETVKISCKASGYTFTNYGMNWVKQAPGKGLKWMGWINTYTGEPTYADDFKGRFALSLETSASTAYLQINNLKNEDMATYFCARYRYNKYERAMDYWGQGTSVTVSS

SEQ ID NO: 2435 - protein, 117 aa, Artificial Sequence
  Description of Artificial Sequence: Synthetic heavy chain variable domain
EIQLQQTGPELVKPGASVKISCKASGYSFTDYIMLWVKQSHGKSLEWIGNINPYSGSSGYNLKFKGKATLTVDKSSSTAYMQLNSLTSEDSAVYYCARGKDFAMDYWGQGTSVTVSS

SEQ ID NO: 2436 - protein, 122 aa, Artificial Sequence
  Description of Artificial Sequence: Synthetic heavy chain variable domain
QVQLQQPGAELVQPGAPVKLSCKASGYIFTSYWMNWVKQRPGRGLEWIGRIDPSDSKIHYNQKFKDKATLTVDRSSSTAYIQLGSLTSEDSAVYYCAKEGGLRRGDYAMDYWGQGTSVTVSS

SEQ ID NO: 2437 - protein, 120 aa, Artificial Sequence
  Description of Artificial Sequence: Synthetic heavy chain variable domain
DVKLVESGGDLVKPGGSLKLSCAASGFTFSSYIMSWVRQTPEKRLEWVATISSGGSSTYYPDSVKGRFTISRDNAKNTLYLQMSSLKSEDTAMYYCTRDDDYDVKVFAYWGQGTLVTVSA

SEQ ID NO: 2438 - protein, 118 aa, Artificial Sequence
  Description of Artificial Sequence: Synthetic heavy chain variable domain
QVQLKESGPGLVQPSQTLSLTCTVSGFSLTSNGVSWVRQPPGKGLEWIAAISSGGTTYYNSAFKSRLSISRNTSKSQVLLKMNSLQTEDTAMYFCARRYGYGWYFDFWGPGTMVTVSS

SEQ ID NO: 2439 - protein, 116 aa, Artificial Sequence
  Description of Artificial Sequence: Synthetic heavy chain variable domain
QVQLKESGPGLVQSSQTLSLTCTVSGFSLTSNGVSWVRQPPGKGLEWIAAISSGGSTYYNSAFKSRLSISRNTSKSQVLLKMNSLQTEDTGMYFCARHRPFYFDYWGQGVMVTVSS

SEQ ID NO: 2440 - protein, 464 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGLTGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2441 - protein, 466 aa, Artificial Sequence
  Description of Artificial Sequence: Synthetic heavy chain variable domain
MEFGLRWIFVQCEVQLLEPGGSLRLSCLVAILKGSGGGLVQAASGFTFSSYAMSWVRQAPGKGLEWVSAISGRGGRTYFADSVKGRFTISRDNSKNTLYLQMNSLRAEDTAVYFCAVEGYSGRYGFFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2442 - protein, 460 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWFSYISSSGSTIYYADSVKGRFTISRDNAKNSLSLQMNSLRAEDTAVYYCARGLTGDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2443 - protein, 462 aa, Artificial Sequence
  Description of Artificial Sequence: Synthetic heavy chain variable domain
MEFGLSWVFLVALLRGCQCQVQLVESGGGVVQPGRSLRLSCAASGFTFSSYGMHWVRQAPGKGLEWVAFIWYDGSNKYYADSVKGRFTISRDNSKNTLYLQMNSLRAEDTAVYYCARGYRVYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQSLSLSPGK

SEQ ID NO: 2444 - protein, 461 aa, Artificial Sequence
  Description of Artificial Sequence: Synthetic heavy chain variable domain
MELGLCWIFLVAIIKGVQCQVQLVESGGGLVKPGGSLRLSCAASGFTFSDYYMSWIRQAPGKGLEWISYISGSGSTIYYADSVKGRFTISRDNAKNSLYLQMNSLRAEDTAVYHCARALGGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2445 - protein, 464 aa, Artificial Sequence
  Description of Artificial Sequence: Synthetic heavy chain variable domain
MEWTWSFLFLVAAATGAHSQVQLVQSGAEVKKPGASVKVSCKASGYTFTSYGISWVRQAPGQGLEWMGWISAYNGNTNYAQKLQDRVTMTTDTSTTTAYMELRSLRSDDTAVYYCARRAYGANFFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2446 - protein, 460 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGLTGDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2447 - protein, 466 aa, Artificial Sequence
  Description of Artificial Sequence: Synthetic heavy chain variable domain
MELGLCWVFLVAILEGVQCEVQLVESGGGLVQPGGSLRLSCAASGFTFSSFSMTWVRQAPGKGLEWVSYISSRSSTISYADSVKGRFTISRDNAKNSLYLQMNSLRDEDTAVYYCARDPLLAGATFFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2448 - protein, 461 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARRIGGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2449 - protein, 458 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGLTGDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQSLSPGK

SEQ ID NO: 2450 - protein, 462 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARRIGGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 2451 - protein, 462 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAIRIGGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 2452 - protein, 461 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGLTGDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 2453 - protein, 467 aa, Artificial Sequence
  Description of Artificial Sequence: Synthetic heavy chain variable domain
MELGLCWVFLVAILEGVQCEVQLVESGGGLVQPGGSLRLSCAASGFTFSSFSMTWVRQAPGKGLEWVSYISSRSSTISYADSVKGRFTISRDNAKNSLYLQMNSLRDEDTAVYYCARDPLLAGATFFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 2454 - protein, 455 aa, Artificial Sequence
  Description of Artificial Sequence: Synthetic heavy chain variable domain
MEFGLCWVFLVAILEGVQCEVQLVESGGGLVQPGGSLRLSCAASGFTFSSYWMSWVRQAPGKGLEWVANIKQDGSEKYYVDSVKGRFTISRDNAKNSLYLQMNSLRAEDTAVAAGRAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2455 - protein, 445 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAIRIGGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGQGNVFSCSVMHEALHNHYTQKSLSLSPGK

SEQ ID NO: 2456 - protein, 461 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARIGGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 2457 - protein, 460 aa, Artificial Sequence; identical to SEQ ID NO: 2446
  Description of Artificial Sequence: Synthetic heavy chain variable domain

SEQ ID NO: 2458 - protein, 461 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGLTGDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 2459 - protein, 461 aa, Artificial Sequence; identical to SEQ ID NO: 2452
  Description of Artificial Sequence: Synthetic heavy chain variable domain

SEQ ID NO: 2460 - protein, 462 aa, Artificial Sequence
  Description of Artificial Sequence: Synthetic heavy chain variable domain
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARRIGGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 2461 - protein, 467 aa, Artificial Sequence; identical to SEQ ID NO: 2453
  Description of Artificial Sequence: Synthetic heavy chain variable domain

SEQ ID NO: 2462 - protein, 467 aa, Artificial Sequence
  Description of Artificial Sequence: Synthetic heavy chain variable domain
MELGLCWVFLVAILEGVQCEVQLVESGGGLVQPGGSLRLSCAASGFTFSSFSMTWVRQAPGKGLEWVSYISSRSSTISYADSVKGRFTISRDNAKNSLYLQMNSLRDEDTAVYYCARDPLLAGATFFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 2463 - protein, 470 aa, Artificial Sequence
  Description of Artificial Sequence: Synthetic heavy chain variable domain
MELGLCWVFLVAILEGVQCEVQLVESGGGLVQPGGSLRLSCAASGFTFSSFSMTWVRQAPGKGLEWVSYISSRSSTISYADSVKGRFTISRDNAKNSLYLQMNSLRDEDTAVYYCARDPLLAGATFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2464 - protein, 224 aa, Artificial Sequence
  Description of Artificial Sequence: Synthetic heavy chain variable domain
QVQLQESGPGLVKPSETLSLTCTVSGGSVSSGSYYWSWIRQPPGKGLEWIGYIYYSGSTNYPSLKSRVTISVDTSKQFSLKLSSVTAADTAVYYCAREGKNGAFDIWGQGTMVTVSSASKGPSVFPLAPSSKSTSGGTAALGCLVKDYFPEPVTVSWNSGALTSGVHTFPAVLQSSGLYSLSSWTVPSSSLGTQTYICNVNHKPSNTKVDKVEPKSCDKSGQAG

SEQ ID NO: 2465 - protein, 118 aa, Artificial Sequence
  Description of Artificial Sequence: Synthetic heavy chain variable domain
QVQLQESGPGLVKPSETLSLTCTVSGGSVSSGSYYWSWIRQPPGKGLEWIGYIYYSGSTNYNPSLKSRWISVDTSKNQFSLLSSVTAADTAVYYCAREGKMGAFDIWGQGTMVTVSSS

SEQ ID NO: 2466 - protein, 223 aa, Artificial Sequence
  Description of Artificial Sequence: Synthetic heavy chain variable domain
EVQLVESGGGLVQPGGSLRLSCAASGFDLGFYFYACWVRQSPGKGLEWVACIYTAGSGSTYYADSVKGRFTISADTSKNTAYLQMNSLRAEDTAIYYCSRSTANTRSTYLNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 2467 - protein, 119 aa, Artificial Sequence
  Description of Artificial Sequence: Synthetic heavy chain variable domain
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSS

SEQ ID NO: 2468 - protein, 231 aa, Artificial Sequence
  Description of Artificial Sequence: Synthetic heavy chain variable domain
EVQLQQSGGELEKPGASVKISCKASGYSFTGYTMNWVKQSHGKSLEWIGLITPYNGASSYNQKFRGKATLTVDKSSSTAYMDLLSLTSEDSAIYFCARGGYDGRGFDYWGSGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 2469 - protein, 120 aa, Artificial Sequence
  Description of Artificial Sequence: Synthetic heavy chain variable domain
AQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSS

SEQ ID NO: 2470 - protein, 121 aa, Artificial Sequence
  Description of Artificial Sequence: Synthetic heavy chain variable domain
QVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSSS

SEQ ID NO: 2471 - protein, 113 aa, Artificial Sequence
  Description of Artificial Sequence: Synthetic heavy chain variable domain
QVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSS

SEQ ID NO: 2472 - protein, 115 aa, Artificial Sequence
  Description of Artificial Sequence: Synthetic heavy chain variable domain
ELVQSGAEVKKPGASVKVSCKASGYTFTTNYMHWVRQAPGQGLEWMGIINPHNGSTSYAQKFQGRVTMTRDTSISTAYMELSSLRSEDTAVYYCARGRYFLMDVWGQGTLVTVSS

SEQ ID NO: 2473 - protein, 115 aa, Artificial Sequence
  Description of Artificial Sequence: Synthetic heavy chain variable domain
ELVESGGGLVQPGGSLRLSCAASGFTFSNNAMNWVRQAPGKGLEWVSGISYDSSKTYYADSVKGRFTISRDNSKNTLYLQMNSLRAEDTAVYYCARLTYTGAYRWGQGTLVTVSS

SEQ ID NO: 2474 - protein, 116 aa, Artificial Sequence
  Description of Artificial Sequence: Synthetic heavy chain variable domain
ELVESGGGLVQPGGSLRLSCAASGFTFSDYSINWVRQAPGKGLEYVSNISYSGSSTYYADSVKGRFTISRDNSKNTLYLQMNSLRAEDTAVYYCARFKYSGGSDSWGQGTLVTVSS

SEQ ID NO: 2475 - protein, 120 aa, Artificial Sequence
  Description of Artificial Sequence: Synthetic heavy chain variable domain
ELVESGGGLVQPGGSLRLSCAASGFTFSSYGISWVRQAPGKGLEWVSGISYSGSSTYYADSVKGRFTISRDNSKNTLYLQMNSLRAEDTAVYYCARLKPYRHKNGWFDYWGQGTLVTVSS

SEQ ID NO: 2476 - protein, 118 aa, Artificial Sequence
  Description of Artificial Sequence: Synthetic heavy chain variable domain
ELVESGGGLVQPGGSLRLSCAASGFTFSSYGISWVRQAPGKGLEWVSSISYSGSNTYYADSVKGRFTISRDNSKNTLYLQMNSLRAEDTAVYYCARMKPMRGYSGAVWGQGTLVTVSS

SEQ ID NO: 2477 - protein, 115 aa, Artificial Sequence
  Description of Artificial Sequence: Synthetic heavy chain variable domain
ELVESGGGLVQPGGSLRLSCAASGFTFSNYGISWVRQAPGKGLEWVSAISYYGSNTYYADSVKGRFTISRDNSKNTLYLQMNSLRAEDTAVYYCARLKGGSGFVWGQGTLVTVSS

SEQ ID NO: 2478 - protein, 119 aa, Artificial Sequence
  Description of Artificial Sequence: Synthetic heavy chain variable domain
ELVESGGGLVQPGGSLRLSCAASGFTFSSYGMSWVRQAPGKGLEWVSGISSLGSTTYYADSVKGRFTISRDNSKNTLYLQMNSLRAEDTAVYYCARTGSPGTFMHGDHWGQGTLVTVSS

SEQ ID NO: 2479 - protein, 119 aa, Artificial Sequence
  Description of Artificial Sequence: Synthetic heavy chain variable domain
ELVQSGAEVKKPGESLKISCKGSGYSFSKYWIGWVRQMPGKGLEWMGIIYPTDSYTRYSPSFQGQVTISADKSISTAYLQWSSLKASDTAMYYCARTHGYYKNGRMDVWGQGTLVTVSS

SEQ ID NO: 2480 - protein, 117 aa, Artificial Sequence
  Description of Artificial Sequence: Synthetic heavy chain variable domain
ELVQSGAEVKKPGESLKISCKGSGYSFTGYISWVRQAPGKGLEWMGIIYPGDSYTNYSPSFQGQVTISADKSISTAYLQWSSLKASDTAMYYCARYSGPNWDVMDSWGQGTLVTVSS

SEQ ID NO: 2481 - protein, 115 aa, Artificial Sequence
  Description of Artificial Sequence: Synthetic heavy chain variable domain
ELVESGGGLVQPGGSLRLSCAASGFTFSSYGMHWVRQAPGKGLEYVSAISYSSSSTSYADSVKGRFTISRDNSKNTLYLQMNSLRAEDTAVYYCARLSYTGFAVWGQGTLVTVSS

SEQ ID NO: 2482 - protein, 153 aa, Artificial Sequence
  Description of Artificial Sequence: Synthetic heavy chain variable domain
MLLLVTSLLLCELPHPAFLLIPEVQLVESGGGLVKPGGSLRLSCSASGFDFDNAWMTWVRQFPGKGLEWVGRITGPGEGWSVDYAAPVEGRFTISRLNSINFLYLEMNNLRMEDSGLYFCARTGKYYDFWSGYPPGEEYFQDWGRGTLVTVSS

SEQ ID NO: 2483 - protein, 118 aa, Artificial Sequence
  Description of Artificial Sequence: Synthetic heavy chain variable domain
EVQLQQSGGERATPGASVKMSCKTSGYTFTNYWMHWVKQRPGQGLEWIGYINPSSGYTQYNQKFKDKATLTADKSSSTAYIQLSSLTSEDSAVYYCSTYYGDYLFPYWGQGTLVTVSA

SEQ ID NO: 2484 - protein, 116 aa, Artificial Sequence
  Description of Artificial Sequence: Synthetic heavy chain variable domain
EVQLQQSGAELVRPGASVKLSCTASGLNIQDYFIHWVKQRPEQGLEWIGRIDPENGDTEYAPKFQGKATMTADTSSNTAYLQLSSLTSEDTAVYYCTSGSRFRDYWGQGTSVTVSS

SEQ ID NO: 2485 - protein, 117 aa, Artificial Sequence
  Description of Artificial Sequence: Synthetic heavy chain variable domain
EVQLQQSGAELVKPGASVKLSCTASGFNIEDHYMHWVKQRTEQGLDWIGRIDPEDGQTKYDPKFQGKATITVDTSSNTAYLQLSSLTSEDTAVYYCARNYPYALDYWGQGTSVTVSS

SEQ ID NO: 2486 - protein, 118 aa, Artificial Sequence
  Description of Artificial Sequence: Synthetic heavy chain variable domain
EVQLVESGGGLVQPGESLKLSCESNEYEFPSHDMSWVRKTPEKRLELVAAINSDGGSTYYPDTMERRFIISRDNTKKTLYLQMSSLRSEDTALYYCVRLYYGNVMDYWGQGTSVTVSS

SEQ ID NO: 2487 - protein, 112 aa, Artificial Sequence
  Description of Artificial Sequence: Synthetic heavy chain variable domain
DVVMTQTPLSLPVSLGDQASISCRSSQSLVHSNGNTYLYWYLQKPGQSPKLLIYKVSNRFSGVPDRFSGSGSGTDFTLKISRVEAEDLGVYFCSQSTHVPLTFGAGTKLELK

SEQ ID NO: 2488 - protein, 120 aa, Artificial Sequence
  Description of Artificial Sequence: Synthetic heavy chain variable domain
QIQLVQSGPELKKPGETVKTSCKASGYTFTGYSMHWVKQAPGKGLKWMGWINTETGEPTYADDFKGRFALSLETSASTTYLQINNLKNEDTATYFCVRGTGGDDWGQGTTLTVSSAKTTP

SEQ ID NO: 2489 - protein, 118 aa, Artificial Sequence
  Description of Artificial Sequence: Synthetic heavy chain variable domain
QVQLQQSGAELMKPGASVKISCKAIGFTFNYFWIEWVKQRPGHGLEWIGEILPGTGSTNYNEKFKGKAIFTADTSSNTAYMQLRSLTSEDSAVYYCVRYDYTSSMDYWGQGTSVTVSS

SEQ ID NO: 2490 - protein, 118 aa, Artificial Sequence
  Description of Artificial Sequence: Synthetic heavy chain variable domain
QITLKESGPGILQPSQTLSLTCSFSGFSLSTSGMGVSWIRQPSGKGLEWLSHIYWDDDKRYNPSLKSRLSISKDTSRNQVFLKITSVDTADTATYYCAPGVSSWFPYWGPGTLVTVSA

SEQ ID NO: 2491 - protein, 119 aa, Artificial Sequence
  Description of Artificial Sequence: Synthetic heavy chain variable domain
QVQLQQPGAELVKPGASEKLSCKASGHTFTSYWMHWVKQRPGQGLEWIGEINPSNGRTYYNENFKTKATLTVDKYSSSASMQLRSLTSEDSAVYYCASDGDYVSGFAYWGQGTTLTVSS

SEQ ID NO: 2492 - protein, 122 aa, Artificial Sequence
  Description of Artificial Sequence: Synthetic heavy chain variable domain
QVTLKESGPGILQPSQTLSLTCSFSGFSLNTLGMGVGWIRQPSGKGLEWLAHIWWDDDKYYNPALKSRLTISKDSSKNQVFLKIANVDTADIATYYCSRIGTAQATDALDYWGQGTSVTVSS

SEQ ID NO: 2493 - DNA, 354 bp, Artificial Sequence
  Description of Artificial Sequence: Synthetic heavy chain variable domain
gaggtgaagctggaggagtcaggacctgaactggtgaagcctggggcttcagtgaagatatcctgcaaggcttctggttactcatttactggctactttatgaactgggtgaagcagacccatggaaagagccttgagtggattggacgtattaatccttacaatggtgctactttctacaatcagaagttcacgggcaaggccacaatgactgtagacaaatcctctaccacagcccacatggagctcctgagcctgacatctgaggactctgcagtctattattgtggaaaggggaattactacggcccctttgattactggggccaagggaccacggtcaccgtctcctca

SEQ ID NO: 2494 - protein, 123 aa, Artificial Sequence
  Description of Artificial Sequence: Synthetic heavy chain variable domain
QVTLKESGPGILQPSQTLSLTCSFSGFSLSTVGMGVGWSRQPSGKGLEWLAHIWWDDEDKYYNPALKSRLTISKDTSKNQVFLKIANVDTADSATYYCTRIGTAQATDALDYWGQGTSVTVSS

SEQ ID NO: 2495 - protein, 122 aa, Artificial Sequence
  Description of Artificial Sequence: Synthetic heavy chain variable domain
QVNLKESGPGKLQPSQTLSLTCSFSGFSLSTLGMGVGWIRQSSGKGLEWLAHIWWDDDKYYNPALKSRLTISRATSKNQVFLKIVNVGTADTATYYCARIGTAQATDALDYWGQGTSVTVSS

SEQ ID NO: 2496 - protein, 123 aa, Artificial Sequence
  Description of Artificial Sequence: Synthetic heavy chain variable domain
QVTLKESGPGILQPSQTLSLTCSFSGFSLSTVGMGVGWSRQPSGKGLEWLAHIWWDDEDKYYNPALKSRLTISKDTSKNQVFLKIANVDTADTATYYCTRIGTAQATDALDYWGQGTSVTVSS

SEQ ID NO: 2497 - DNA, 366 bp, Artificial Sequence
  Description of Artificial Sequence: Synthetic heavy chain variable domain
gtgaagctggaggagtcagggggaggcttcgtgaagcctggagggtccctcaaaatctcctgtgcagcctctggattcactttcagaaactatgccatgtcctgggttcgcctgagtccggagatgaggctggagtgggtcgcaaccattagcagtgctggtggttacatcttctattctgacagtgtgcagggacgattcaccatttccagagacaatgccaagaacaccctccacttgcaaatgggcagtctgaggtctggggacacggccatgtattactgtgcaaggcagggatttggtaactacggtgattactatgctatggactactggggccaagggaccacggtcaccgtctcctca

SEQ ID NO: 2498 - DNA, 366 bp, Artificial Sequence
  Description of Artificial Sequence: Synthetic heavy chain variable domain
gtgaagctgcaggagtcagggggaggcttcgtgaagcctggagggtccctcaaagtctcctgtgcagcctctggattcactttcagtagctatgccatgtcctgggttcgcctgagtccggagatgaggctggagtgggtcgcaaccattagcagtgctggtggttacatcttctattctgacagtgtgcagggacgattcaccatttccagagacaatgccaagaacaccctgcacctgcaaatgggcagtctgaggtctggggacacggccatgtattactgtgcaaggcagggatttggtaactacggtgattactatgctatggactactggggccaagggaccacggtcaccgtctcctca

SEQ ID NO: 2499 - protein, 122 aa, Artificial Sequence
  Description of Artificial Sequence: Synthetic heavy chain variable domain
QVTLKESGPGILQPSQTLSLTCSFSGFSLNTLGMGVGWIRQPSGKGLEWLAHIWWDDDKYYYPALKSRLTISRDTSKNQVFLKIANVDTADTATYYCARIGTAQATDALDYWGQGTSVTVSS

SEQ ID NO: 2500 - DNA, 348 bp, Artificial Sequence
  Description of Artificial Sequence: Synthetic heavy chain variable domain
gtgaagctggaggagtcagggggagacttggtgaagcctggagggtccctgaaactctcctgtgcagtctctggattcactttcagtagccattccatgtcttggattcgtcagactccagagaagaggctagagtgggtcgcatccgtgagtagtggtggtaggatctactattcggacagtgtgaagggccgattcaccgtcaccagagaaaatgacaggaacaccctgtatttgttaatgagtagtctgaggtctgaggacacggccatgtattattgtggaagaggacaggtattttatgctttggacaattggggccaagggaccacggtcaccgtctcctca

SEQ ID NO: 2501 - protein, 123 aa, Artificial Sequence
  Description of Artificial Sequence: Synthetic heavy chain variable domain
EVQLVESGGGLVQPGGSLRLSCAASGFTVSSNYMSWVRQAPGKGLEWVSVIYSGGSTYYADSVKGRFIISRDNSKNTLYLQMNSLRAEDTAVYYCARDQEHYFDGSGYYVDYWGQGTLVTVSS

SEQ ID NO: 2502 - protein, 107 aa, Artificial Sequence
  Description of Artificial Sequence: Synthetic heavy chain variable domain
SLRLSCAASGFTVSSNYMSWVRQAPGKGLEWVSVIYSGGSTYYADSVKGRFTISRDNSKNTLYLQMNSLRAEDTAVYYCARDQEHYFDGSGYYVDYWGQGTLVTVSS

SEQ ID NO: 2503 - protein, 121 aa, Artificial Sequence
  Description of Artificial Sequence: Synthetic heavy chain variable domain
EVQLVESGGGLVQPGGSLRLSCAASGFTVSSNYMSWVRQAPGKGLEWVSVIYSGGTTYYADSVKGRFTISRHNSKNTLYLQMNSLRAEDTAVYYCARDHDPDYGGYYMDVWGKGTTVTVSS

SEQ ID NO: 2504 - protein, 128 aa, Artificial Sequence
  Description of Artificial Sequence: Synthetic heavy chain variable domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARERIGYCTGGNCFYYYYMDVWGKGTTVTVSS

SEQ ID NO: 2505 - protein, 128 aa, Artificial Sequence
  Description of Artificial Sequence: Synthetic heavy chain variable domain
QVQLVESGGGLVKPGGSLRLSCAASGFTFSDYYMSWIRQAPGKGLEWVSYISSSGTTKYYADSVKGRFTISRDNAKNSLYLQMNSLRAEDTAVYYCVRENIGYCTGGNCFYYYYMDVWGKGTTVTVSS

SEQ ID NO: 2506 - protein, 128 aa, Artificial Sequence
  Description of Artificial Sequence: Synthetic heavy chain variable domain
QVQLVESGGGLVKPGGSLRLSCAASGFTFSDYYMSWIRQAPGKGLEWVSYISSSGTTKYYADSVKGRFTISRDNAKNSLYLQMNSLRAEDTAVYYCVRENLGYCSGGSCFYYYYMDVWGKGTTVTVSS

SEQ ID NO: 2507 - protein, 128 aa, Artificial Sequence
  Description of Artificial Sequence: Synthetic heavy chain variable domain
QVQLVESGGGLVKPGGSLRLSCAASGFTFSDYYMSWIRQAPGKGLEWISYISSSGSTIYYADSVKGRFTISRDNAKNSLYLQMNSLRAEDTAVYYCARERIGYCSGGSCFYYYYMDVWGKGTTVTVSS

SEQ ID NO: 2508 - protein, 128 aa, Artificial Sequence
  Description of Artificial Sequence: Synthetic heavy chain variable domain
QVQLVESGGGLVKPGGSLRLSCAASGFTFSDYYMSWIRQAPGKGLEWVSYISSSGTTKYYADSVKGRFTISRDNAKNSLYLHLNSLRAEDTAVYYCVRENLGYCSGGSCFYYYYMDVWGKGTTVTVSS

SEQ ID NO: 2509 - protein, 127 aa, Artificial Sequence
  Description of Artificial Sequence: Synthetic heavy chain variable domain
QLQLQESGPGLVKPSETLSLTCTVSGGSISSSSYYWGWIRQPPGKGLEWIGSIYYSGSTHYNPSLKRRVTISEDTSKNQFSLKLSSVTAADTAVYYCARGVVEVRGNHYYYYYMDVWGKGTTVTVSS

SEQ ID NO: 2510 - protein, 127 aa, Artificial Sequence
  Description of Artificial Sequence: Synthetic heavy chain variable domain
QLQLQESGPGLVKPSETLSLTCTVSGGSISSSSYYWGWIRQPPGKGLEWIGSIYYSGSTHYNPSLKSRVTISVDTSKNQFSLKLRSVTAADTAVYYCARGVVEVRGNHYYYYYMDVWGKGTTVTVSS

SEQ ID NO: 2511 - protein, 127 aa, Artificial Sequence
  Description of Artificial Sequence: Synthetic heavy chain variable domain
QLQLQESGPGLVKPSETLSLTCTVSGGSISSSSYYLGWIHQPPGMGLEWIGSIYYSGSTHYNPSLKSRVTISVDTSKNQFSLKLRSVTAADTAVYYCARGVVEVRGNHYYYYYMDVWGKGTTVTVSS

SEQ ID NO: 2512 - protein, 127 aa, Artificial Sequence
  Description of Artificial Sequence: Synthetic heavy chain variable domain
QLQLQESGPGLVKPSETLSLTCTVSGGSISSSSYYVGWIRHAPGKGLEWIGSIYYSGSTHYNPSLKRRVTISEDTSKNQFSLKLSSVTAADTAVYYCARGVVEVRGNHYYYYHMDAWGKGTTVTVSS

SEQ ID NO: 2513 - protein, 127 aa, Artificial Sequence
  Description of Artificial Sequence: Synthetic heavy chain variable domain
QLQLQESGPGLVKPSETLSLTCTVSGGSISSSSYYWGWIRQPPGKGLEWIGSIYYSGSTHYNPSLKRRVTISEDTSKNQFSLKLSSVTAADTAVYYCARGVVEVRGNHYYYYHMDAWGKGTTVTVSS

SEQ ID NO: 2514 - protein, 127 aa, Artificial Sequence
  Description of Artificial Sequence: Synthetic heavy chain variable domain
QLQLQESGPGLVKPSETLSLTCTVSGGSISSSSYYWGWIRQPPGKGLEWIGSIYYSGSTHYTPSLKSRVTISVDTSKNQFSLKLSSVTAADTAVYYCARGVVEVRGNHYYYYHMDAWGKGTTVTVSS

SEQ ID NO: 2515 - protein, 122 aa, Artificial Sequence
  Description of Artificial Sequence: Synthetic heavy chain variable domain
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARGSTNTYYYDSSGHPWGQGTMVTVSS

SEQ ID NO: 2516 - protein, 123 aa, Artificial Sequence
  Description of Artificial Sequence: Synthetic heavy chain variable domain
QLQLQESGPGLVKPSETLSLTCTVSGGSISSSRYYWGWIRQPPGKGLEWIGSIYYSGSTYYNPSLKSRVTISVDTSNNQFSLKLTSVTAADTAVYYCARLPESGGYSGWFDPWGQGTLVTVSS

SEQ ID NO: 2517 - protein, 128 aa, Artificial Sequence
  Description of Artificial Sequence: Synthetic heavy chain variable domain
QVQLVESGGGLVKPGGSLRLSCAASGFTFSDYYMSWIRQAPGKGLEWVSYISSSGTTKYYADSVKGRFTISRDNAKNSLYLQMNSLRAEDTAVYYCARERIGYCSGGSCYYYYYMDVWGKGTTVTVSS

SEQ ID NO: 2518 - protein, 128 aa, Artificial Sequence
  Description of Artificial Sequence: Synthetic heavy chain variable domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARERIGYCSGGSCYYYYYMDVWGKGTTVTVSS

SEQ ID NO: 2519 - protein, 128 aa, Artificial Sequence
  Description of Artificial Sequence: Synthetic heavy chain variable domain
QVQLVESGGGLVKPGGSLRLSCAASGFTFSDYYMSWIRQAPGKGLEWVSYISSSGTTKYYADSVKGRFTISRDNAKNSLYLQMNSLRAEDTAVYYCVRENLGYCSGGSCYYYYYMDVWGKGTTVTVSS

SEQ ID NO: 2520 - protein, 128 aa, Artificial Sequence
  Description of Artificial Sequence: Synthetic heavy chain variable domain
QVQLVESGGGLVKPGGSLRLSCAASGFTFSDYYMSWIRQAPGKGLEWVSYISSSGSTKYYADSVKGRFTISRDNAKNSLYLQMNSLRAEDTAVYYCVRENLGYCTGGNCFYYYYMDVWGKGTTVTVSS

SEQ ID NO: 2521 - protein, 128 aa, Artificial Sequence
  Description of Artificial Sequence: Synthetic heavy chain variable domain
QVQLVESGGGLVKPGGSLRLSCAASGFTFSDYYMSWIRQAPGKGLEWVSYISSSGTTKYYADSVKGRFTISRDNAKNSLYLQMNSLRAEDTAVYYCVRENLGYCTGGNCFYYYYMDVWGKGTTVTVSS

SEQ ID NO: 2522 - protein, 128 aa, Artificial Sequence
  Description of Artificial Sequence: Synthetic heavy chain variable domain
QVQLVESGGGLVKPGGSLRLSCAASGFTFSDYYMSWIRQAPGKGLEWVSYISSSGTTKYYADSVKGRFTISRDNAKNSLYLQMNSLRAEDTAVYYCVRENIGYCSGGSCFYYYYMDVWGKGTTVTVSS

SEQ ID NO: 2523 - protein, 128 aa, Artificial Sequence
  Description of Artificial Sequence: Synthetic heavy chain variable domain
QVQLVESGGGLVKPGGSLRLSCAASGFIFSDYYMSWIRQAPGKGLEWVSYISSSGTTKYYADSVKGRFTISRDNAKNSLYLQMNSLRAEDTAVYYCVREDIGYCSGGSCFYYYYMDVWGKGTTVTVSS

SEQ ID NO: 2524 - protein, 113 aa, Artificial Sequence
  Description of Artificial Sequence: Synthetic heavy chain variable domain
EVQLVESGGGLVQPGGSLRLSCAASGFTFSSYWMHWVRQAPGKGLVWVSHINSDGSSTSYADSVKGRFTISRDNAKNTLYLQMNSLRAEDTAVYYCARELADWGQGTLVTVSS

SEQ ID NO: 2525 - protein, 121 aa, Artificial Sequence; identical to SEQ ID NO: 2421
  Description of Artificial Sequence: Synthetic heavy chain variable domain

SEQ ID NO: 2526 - protein, 159 aa, Artificial Sequence
  Description of Artificial Sequence: Synthetic heavy chain variable domain
MLLLVTSLLLCELPHPAFLLIPQPQLQESGPGLVEASETLSLTCTVSGDSTAACDYFWGWVRQPPGKGLEWIGGLSHCAGYYNTGWTYHNPSLKSRLTISLDTPKNQVFLKLNSVTAADTAIYYCARFDGEVLVYHDWPKPAWVDLWGRGTLVTVTVSS

SEQ ID NO: 2527 - protein, 157 aa, Artificial Sequence
  Description of Artificial Sequence: Synthetic heavy chain variable domain
MLLLVTSLLLCELPHPAFLLIPQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSS

SEQ ID NO: 2528 - protein, 119 aa, Artificial Sequence
  Description of Artificial Sequence: Synthetic heavy chain variable domain
EVQLVESGGGLVKPGGSLKLSCAASGFTFSSYAMSWVRQSPEKRLEWVAEISSGGSYTYYPDTVTGRFTISRDNAKNTLYLEISSLRSEDTAMYYCTRHGDYPRFFDVWGAGTTVTVSS

SEQ ID NO: 2529 - protein, 452 aa, Artificial Sequence
  Description of Artificial Sequence: Synthetic heavy chain variable domain
EVQLVQSGAEVKKPGESLKISCKGSGYSFTSYWMNWVRQMPGKGLEWMGRIDPYDSETHYSPSFQGQVTISADKSISTAYLQWSSLKASDTAMYYCARGGYDFDVGTLYWFFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2530 - protein, 452 aa, Artificial Sequence
  Description of Artificial Sequence: Synthetic heavy chain variable domain
QVQLVQSGAEVKKPGASVKVSCKASGYTFTSYWMNWVRQAPGQGLEWMGRIDPYDSETHYAQKLQGRVTMTTDTSTSTAYMELRSLRSDDTAVYYCARGGYDFDVGTLYWFFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2531 - protein, 452 aa, Artificial Sequence
  Description of Artificial Sequence: Synthetic heavy chain variable domain
EVQLVQSGAEVKKPGESLRISCKGSGYSFTSYWMNWVRQMPGKGLEWMGRIDPYDSETHYSPSFQGHVTISADKSISTAYLQWSSLKASDTAMYYCARGGYDFDVGTLYWFFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2532 - protein, 452 aa, Artificial Sequence
  Description of Artificial Sequence: Synthetic heavy chain variable domain
EVQLVQSGAEVKKPGATVKISCKVSGYTFTSYWMNWVQQAPGKGLEWMGRIDPYDSETHYAEKFQGRVTITADTSTDTAYMELSSLRSEDTAVYYCATGGYDFDVGTLYWFFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2533 - protein, 452 aa, Artificial Sequence
  Description of Artificial Sequence: Synthetic heavy chain variable domain
QVQLVQSGAEVKKPGASVKVSCKASGYTFTSYWMNWVRQAPGQGLEWMGRIDPYDSETHYAQKFQGRVTMTRDTSTSTVYMELSSLRSEDTAVYYCARGGYDFDVGTLYWFFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2534 - protein, 118 aa, Artificial Sequence
  Description of Artificial Sequence: Synthetic heavy chain variable domain
EVQLVESGGGVVQPGGSLRLSCAASGFTFSSYGMHWVRQAPGKGLEWVAFIRYDGSNKYYADSVKGRFTISRDNSKNTKYLQMNSLRAEDTAVYYCAKDRFGYYLDYWGQGTLVTVSS

SEQ ID NO: 2535 - protein, 121 aa, Artificial Sequence
  Description of Artificial Sequence: Synthetic heavy chain variable domain
QVQLVESGGGLVKPGGSLRLSCAASGFTFSSYGMHWVRQAPGKGLEWVAFIRYDGSNKYYADSVKGRFTISRDNSKNTLYLQMNSLRAEDTAVYYCAKDRGLGDGTYFDYWGQGTTVTVSS

SEQ ID NO: 2536 - protein, 466 aa, Artificial Sequence
  Description of Artificial Sequence: Synthetic heavy chain variable domain
MDWTWRVFCLLAVAPGVLSQVQLVQSGAEVKKPGASVKISCKVSGYTLRGYWIEWVRQAPGKGLEWIGQILPGTGRTNYNEKFKGRVTMTADTSTDTAYMELSSLRSEDTAVYYCARFDGNYGYYAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2537 - protein, 441 aa, Artificial Sequence
  Description of Artificial Sequence: Synthetic heavy chain variable domain
EVQLVESGGGLVQPGGSLRLSCAASGFTFSSSGMSWVRQAPGKGLEWVSVIASSGSNTYYADSVKGRFTISRDNSKNTLYLQMNSLRAEDTAVYYCARSIFYTTWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2538 - protein, 227 aa, Artificial Sequence
  Description of Artificial Sequence: Synthetic heavy chain variable domain
EVQLVESGGGLVQPGGSLRLSCAASGFTFSSYWIHWVRQSPGKGLEWVARINPPNRSNQYADSVKGRFTISADTSKNTAYLQMNSLRAEDTAIYYCARGSGFRWVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 2539 - protein, 119 aa, Artificial Sequence
  Description of Artificial Sequence: Synthetic heavy chain variable domain
DVQLVESGGGLVQPGGSRKISCAASGFTFSSYGMHWVRQAPEKGLEWVAYISSSTVTTYYADTVKGRFTISRDNANNTLFLQMTSLRSEDTAMYYCSRQNWDGGYFDVWGAGTTVTVSS

SEQ ID NO: 2540 - protein, 119 aa, Artificial Sequence
  Description of Artificial Sequence: Synthetic heavy chain variable domain
EVQLVESGGGLVQPGGSLRLSCAASGFTFSSYGMNWVRQAPGKGLEWVSYISSSTVTTYYADSVKGRFTISRDNAKNSLYLQMNSLRDEDTAVYYCSRQNWDGGYFDVWGAGTTVTVSS

SEQ ID NO: 2541 - protein, 117 aa, Artificial Sequence
  Description of Artificial Sequence: Synthetic heavy chain variable domain
AVHLVESGGGLVQPKESLKISCAASGFTFSNAAMYWVRQAPGKGLEWVARIRTKPNDYATYYVDSVKGRFTISRDDSQSMVYLQMDNLKTEDTAMYYCTAFTEPDYWGQGVMVTVSS

SEQ ID NO: 2542 - protein, 120 aa, Artificial Sequence
  Description of Artificial Sequence: Synthetic heavy chain variable domain
QVQLKESGPGLVQPSQTLSLTCTVSGFSLTRNNVHWVRQPPGKGLEWMGRMRYNGDTSYNSALKSRLSISRDTSKNQVFLKMNSLQIDDTGTYYCSREGYYDGTYYPDYWGQGVMVTVSS

SEQ ID NO: 2543 - protein, 117 aa, Artificial Sequence
  Description of Artificial Sequence: Synthetic heavy chain variable domain
EVQLVETGGSLVQPGKSLKLTCATSGFTFSNAWMHWVRQSPEKQLEWVAQIKAKSNNYATYYAESVKGRFTISRDDSKSSIYLQMNSLKEEDTAIYYCLYGYYFDYWGQGVMVTVSS

SEQ ID NO: 2544 - protein, 140 aa, Artificial Sequence
  Description of Artificial Sequence: Synthetic heavy chain variable domain
QVQLQQSDAELVKPGASVKISCKVSGYTFTDHTIHWMKQRPEQGLEWIGYIYPRDGSTKYNEKFKGKATLTADKSSSTTYMQLNSLTSEDSAVYFCARLAFGIITTVVRYFDVWGTGTTVTVSSAKTTAPSVYPLAPGSL

SEQ ID NO: 2545 - protein, 444 aa, Artificial Sequence
  Description of Artificial Sequence: Synthetic heavy chain variable domain
QVQLVESGGGVVQPGRSLRLSCAASGFTFSNYALHWVRQAPGKGLEWVALISYDGSRKHYADSVKGRFSISRDNSKNTLYLQMNSLRAEDTAVYYCASLTYVREWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2546 - protein, 444 aa, Artificial Sequence
  Description of Artificial Sequence: Synthetic heavy chain variable domain
QVQLVESGGGVVQPGRSLRLSCAASGFTFSNYALHWVRQAPGKGLEWVALISYSGSRKHYADSVKGRFSISRDNSKNTLYLQMNSLRAEDTAVYYCASLTMVREGGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2547 - protein, 444 aa, Artificial Sequence
  Description of Artificial Sequence: Synthetic heavy chain variable domain
QVQLVESGGGVVQPGRSLRLSCAASGFTFSNYALHWVRQAPGKGLEWVALISYDSSRKHYADSVKGRFSISRDNSKNTLYLQMNSLRAEDTAVYYCASLTMVREGGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2548 - protein, 444 aa, Artificial Sequence
  Description of Artificial Sequence: Synthetic heavy chain variable domain
QVQLVESGGGVVQPGRSLRLSCAASGFTFSNYALHWVRQAPGKGLEWVALISYSGSRKHYADSVKGRFSISRDNSKNTLYLQMNSLRAEDTAVYYCASLTMVREWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2549 - protein, 444 aa, Artificial Sequence
  Description of Artificial Sequence: Synthetic heavy chain variable domain
QVQLVESGGGVVQPGRSLRLSCAASGFTFSNYALHWVRQAPGKGLEWVALISYDSSRKHYADSVKGRFSISRDNSKNTLYLQMNSLRAEDTAVYYCASLTMVREWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2550 - protein, 444 aa, Artificial Sequence
  Description of Artificial Sequence: Synthetic heavy chain variable domain
QVQLVESGGGVVQPGRSLRLSCAASGFTFSNYALHWVRQAPGKGLEWVALISYSGSRKHYADSVKGRFSISRDNSKNTLYLQMNSLRAEDTAVYYCASLTYVREWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2551 - protein, 444 aa, Artificial Sequence
  Description of Artificial Sequence: Synthetic heavy chain variable domain
QVQLVESGGGVVQPGRSLRLSCAASGFTFSNYALHWVRQAPGKGLEWVALISYDSSRKHYADSVKGRFSISRDNSKNTLYLQMNSLRAEDTAVYYCASLTYVREWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2552 - protein, 446 aa, Artificial Sequence
  Description of Artificial Sequence: Synthetic heavy chain variable domain
EVQLVQSGGGLVQPGGSLRLSCAGSGFTFSSYAMYWVRQAPGKGLEWVSAIDTDGGTFYADSVRGRFTISRDNAKNSLYLQMNSLRAEDTAVYFCARLGEGYFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2553 - protein, 446 aa, Artificial Sequence
  Description of Artificial Sequence: Synthetic heavy chain variable domain
EVQLVESGGGLVQPGGSLRLSCAASGFTFSSYDMHWVRQTTGKGLEWVSVIGTAGDTYYPGSVKGRFTISRENAKNSLYLQMNSLRAGDTAVYYCARGGMGNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2554 - protein, 449 aa, Artificial Sequence
  Description of Artificial Sequence: Synthetic heavy chain variable domain
QVQLVQSGAEVKKPGASVKVSCKASGYTFTSYDVNWVRQATGQGLEWMGWMNPNSGNTGYAPKFQGRVTMTRDTSISTAYMELSSLRSEDTAVYYCARIYSSSYNWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2555 - protein, 444 aa, Artificial Sequence
  Description of Artificial Sequence: Synthetic heavy chain variable domain
QVQLVESGGGVVQPGRSLRLSCAASGFTFSNYALHWVRQAPGKGLEWVALISYDGSRKHYADSVKGRFSISRDNSKNTLYLQMNSLRAEDTAVYYCASLTLVREWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2556 - protein, 446 aa, Artificial Sequence
  Description of Artificial Sequence: Synthetic heavy chain variable domain
EVQLVQSGGGLVQPGGSLRLSCAGSGFTFSSYAMYWVRQAPGKGLEWVSAIDTSGGTFYADSVRGRFTISRDNAKNSLYLQMNSLRAEDTAVYFCARLGEGYFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2557 - protein, 446 aa, Artificial Sequence
  Description of Artificial Sequence: Synthetic heavy chain variable domain
EVQLVQSGGGLVQPGGSLRLSCAGSGFTFSSYAMYWVRQAPGKGLEWVSAIDTDAGTFYADSVRGRFTISRDNAKNSLYLQMNSLRAEDTAVYFCARLGEGYFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2558 - protein, 446 aa, Artificial Sequence
  Description of Artificial Sequence: Synthetic heavy chain variable domain
EVQLVQSGGGLVQPGGSLRLSCAGSGFTFSSYAMYWVRQAPGKGLEWVSAIDTSTGTFYADSVRGRFTISRDNAKNSLYLQMNSLRAEDTAVYFCARLGEGYFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2559 - protein, 228 aa, Artificial Sequence
  Description of Artificial Sequence: Synthetic heavy chain variable domain
EVQLVESGGGLVQPGGSLRLSCAASGFTFTNYGIHWIRQAPGKGLEWVASISPSGGLTYYRDSVKGRFTISRDDAKNSPYLQMNSLRAEDTAVYYCATGGEGIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCAA

SEQ ID NO: 2560 - protein, 120 aa, Artificial Sequence
  Description of Artificial Sequence: Synthetic heavy chain variable domain
QVQLVQSGAEVKKPGASVKVSCKASGNTFTSYDVNWVRQATGQGLEWMGWMNPNSGNTGYAPKFQGRVTMTRNTSISTAYMELSSLRSEDTAVYYCARIYSSSYNWFDPWGQGTLVTVSS

SEQ ID NO: 2561 - protein, 118 aa, Artificial Sequence
  Description of Artificial Sequence: Synthetic heavy chain variable domain
EVQLEQSGAEVKKPGESLKISCKGSGYSFTSNWIGWVRQMPGKGLEWMGFIYPGDSDTRYSPSFQGQVTISADKSISTAYLQWSSLKASDIAMYYCARYGDDWYFDLWGRGTLVTVSS

SEQ ID NO: 2562 - protein, 107 aa, Artificial Sequence
  Description of Artificial Sequence: Synthetic heavy chain variable domain
EIVLTQSPATLSLSPGERATLSCRASQSVSSYLAWFQQRPGQAPRLLIYDASNRATGIPARFSGSGSGTDFSLTISSLEPEDFAVYYCQQRGDWPITFGQGTRLEIK

SEQ ID NO: 2563 - protein, 451 aa, Artificial Sequence
  Description of Artificial Sequence: Synthetic heavy chain variable domain
EVQLVESGGGLVQPGGSLRLSCAASGFTFSNYTMNWVRQAPGKGLEWVSAISGSGGSTYYADSVKGRFTISRDNSKNTLYLQMNSLRAEDTAVYYCAKDRYSQVHYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2564 - protein, 117 aa, Artificial Sequence
  Description of Artificial Sequence: Synthetic heavy chain variable domain
EVQLVQSGGGLVQPGGSLRLSCAGSGFTFSSYAMYWVRQAPGKGLEWVSAIDTDAGTFYADSVRGRFTISRDNAKNSLYLQMNSLRAEDTAVYFCARLGEGYFFDYWGQGTLVTVSS

SEQ ID NO: 2565 - protein, 121 aa, Artificial Sequence
  Description of Artificial Sequence: Synthetic heavy chain variable domain
QVQLQESGPGLVKPSQTLSLTCAVYGGSFSSGYWNWIRQHPGKGLEWIGYISYNGITYHNPSLKSRITINPDTSKNQFSLQLNSVTPEDTAVYYCARYRYDYDGGHAMDYWGQGTLVTVSS

SEQ ID NO: 2566 - protein, 450 aa, Artificial Sequence
  Description of Artificial Sequence: Synthetic heavy chain variable domain
EVQLVESGGGLVHPGGSLRLSCAGSGFTFSSYAMHWVRQAPGKGLEWVSAIGTGGGTYYADSVMGRFTISRDNSKNTLYLQMNSLRAEDTAVYYCARYDNVMGLYWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2567 - protein, 121 aa, Artificial Sequence
  Description of Artificial Sequence: Synthetic heavy chain variable domain
QVQLQESGPGLVKPSQTLSLTCAVYGGSFSSGYWNWIRKHPGKGLEWIGYISYNGITYHNPSLKSRITINRDTSKNQFSLQLNSVTPEDTAVYYCARYRYDYDGGHAMDYWGQGTLVTVSS

SEQ ID NO: 2568 - protein, 118 aa, Artificial Sequence
  Description of Artificial Sequence: Synthetic heavy chain variable domain
EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFDYWGQGTLVTVSS

SEQ ID NO: 2569 - protein, 121 aa, Artificial Sequence
  Description of Artificial Sequence: Synthetic heavy chain variable domain
QVQLQESGPGLVKPSQTLSLTCAVYGDSFSSGYWNWIRKHPGKGLEYMGYISYNGITYHNPSLKSRITINRDTSKNQYSLQLNSVTPEDTAVYFCARYRYDYDGGHAMDYWGQGTLVTVSS

SEQ ID NO: 2570 - protein, 117 aa, Artificial Sequence
  Description of Artificial Sequence: Synthetic heavy chain variable domain
EVQLVQSGGGLVHPGGSLRLSCAGSGFTFSNYAMYWVRQAPGKGLEWVSAIGIGGDTFYTDSVKGRFTISRDNAKNSLSLQMNSLRAEDMAVYYCARMGTGYFFDYWGQGTLVTVSS

SEQ ID NO: 2571 - protein, 124 aa, Artificial Sequence
  Description of Artificial Sequence: Synthetic heavy chain variable domain
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDQSTADYYFYYGMDVWGQGTTVTVSS

SEQ ID NO: 2572 - protein, 121 aa, Artificial Sequence
  Description of Artificial Sequence: Synthetic heavy chain variable domain
QVQLQESGPGLVKPSQTLSLTCAVYGDSFSSGYWNWIRKHPGKGLEYIGYISYNGITYHNPSLKSRITINRDTSKNQYSLQLNSVTPEDTAVYFCARYRYDYDGGHAMDYWGQGTLVTVSS

SEQ ID NO: 2573 - protein, 122 aa, Artificial Sequence
  Description of Artificial Sequence: Synthetic heavy chain variable domain
QVQLVQSGSELKKPGASVKVSCKASGYTFTDYSMHWVRQAPGQGLKWMGWINTETGEPTYADDFKGRFVFSLDTSVSTAYLQISSLKAEDTAVYYCANPYYDYVSYYAMDYWGQGTTVTVSS

SEQ ID NO: 2574 - protein, 121 aa, Artificial Sequence
  Description of Artificial Sequence: Synthetic heavy chain variable domain
QVQLQESGPGLVKPSQTLSLTCAVYGDSFSSGYWNWIRKHPGKGLEYIGYISYNGITYHNPSLKSRITINRDTSKNQFSLQLNSVTPEDTAVYFCARYRYDYDGGHAMDYWGQGTLVTVSS

SEQ ID NO: 2575 - protein, 120 aa, Artificial Sequence
  Description of Artificial Sequence: Synthetic heavy chain variable domain
EVQLVESGGGLVQPGGSLRLSCAASEYEFPSHDMSWVRQAPGKGLELVAAINSDGGSTYYPDTMERRFTISRDNAKNSLYLQMNSLRAEDTAVYYCARHYDDYYAWFAYWGQGTMVTVSS

SEQ ID NO: 2576 - protein, 121 aa, Artificial Sequence
  Description of Artificial Sequence: Synthetic heavy chain variable domain
QVQLQESGPGLVKPSQTLSLTCAVYGDSFSSGYWNWIRKHPGKGLEYIGYISYNGITYHNPSLKSRITINRDTSKNQYSLQLNSVTPEDTAVYYCARYRYDYDGGHAMDYWGQGTLVTVSS

SEQ ID NO: 2577 - protein, 469 aa, Artificial Sequence [sequence omitted]

SEQ ID NO: 2578 - protein, 136 aa, Artificial Sequence
  Description of Artificial Sequence: Synthetic heavy chain variable domain
MDTLCSTLLLLTIPSWVLSQITLKESGPTLVKPTQTLTLSCTFSGFSLSTSGVGVGWIRQPPGKALEWLALIHWDDAERYSPSLKSRLTITKDTSKNQVVLTMTNMDLVDTATYYCAHTRGAFDIWGQGTMVTVSS

SEQ ID NO: 2579 - protein, 121 aa, Artificial Sequence
  Description of Artificial Sequence: Synthetic heavy chain variable domain
QVQLQESGPGLVKPSQTLSLTCAVYGDSFSSGYWNWIRKHPGKGLEYIGYISYNGITYHNPSLKSRITINRDTSKNQFSLQLNSVTPEDTAVYYCARYRYDYDGGHAMDYWGQGTLVTVSS

SEQ ID NO: 2580 - protein, 119 aa, Artificial Sequence
  Description of Artificial Sequence: Synthetic heavy chain variable domain
EVQLQQSGPELVKPGASVKMSCKASGYTFTSYVMHWVKQKPGQGLEWIGYINPYNDGTKYNEKFKGKATLTSDKSSSTAYMELSSLTSEDSAVYYCANYYGSSLSMDYWGQGTSVTVSS

SEQ ID NO: 2581 - protein, 136 aa, Artificial Sequence
  Description of Artificial Sequence: Synthetic heavy chain variable domain
MDTLCSTLLLLTIPSWVLSQITLKESGPTLVKPTQTLTLTCTFSGFSLSTSGVGVGWIRQPPGKALEWLALIYWDDHSPYSPSLKSRLTITKDTSKNQVVLTMTNMDPVDTATYYCARTRGAFDIWGQGTMVTVSS

SEQ ID NO: 2582 - protein, 121 aa, Artificial Sequence
  Description of Artificial Sequence: Synthetic heavy chain variable domain
QVQLQESGPGLVKPSQTLSLTCAVYGGSFSSGYWNWIRKHPGKGLEYIGYISYNGITYHNPSLKSRITINPDTSKNQYSLQLNSVTPEDTAVYFCARYRYDYDGGHAMDYWGQGTLVTVSS

SEQ ID NO: 2583 - protein, 121 aa, Artificial Sequence
  Description of Artificial Sequence: Synthetic heavy chain variable domain
EVQLQQSGPELVKPGASVKISCKTSGYTFKDYTMHWVKQSHGKSLEWIGGIYPNNGGSTYNQNFKDKATLTVDKSSSTAYMEFRSLTSEDSAVYYCARMGYHGPHLDFDVWGAGTTVTVSP

SEQ ID NO: 2584 - protein, 154 aa, Artificial Sequence
  Description of Artificial Sequence: Synthetic heavy chain variable domain
MTMITPSLVPSSDPLVTAASVLEFALLIRLTIGQAVVSTQSTGGGLVQPGRSLRLSCAASGFTLDDYGMHWVRQAPGKGLEWVSGISWNSDSIGYVDSVKGRFTISRDNAKNSLYLQMNSLRVEDTALYYCVKDISGWYSFDYWGQGTLVTVSS

SEQ ID NO: 2585 - protein, 121 aa, Artificial Sequence
  Description of Artificial Sequence: Synthetic heavy chain variable domain
QVQLVESGGGVVQPGRSLRLSCAASGFTFSSFAMHWVRQAPGKGLEWVTVISYDGSIKYYTDSVKGRFTFSRDNSKNTLYLQMNSLRAEDTAVYYCTRDGNYGSARYFQHWGQGTLVTVSS

SEQ ID NO: 2586 - protein, 121 aa, Artificial Sequence
  Description of Artificial Sequence: Synthetic heavy chain variable domain
QVQLQESGPGLVKPSQTLSLTCAVYGGSFSSGYWNWIRKHPGKGLEYIGYISYNGITYHNPSLKSRITINRDTSKNQYSLQLNSVTPEDTAVYFCARYRYDYDGGHAMDYWGQGTLVTVSS

SEQ ID NO: 2587 - protein, 119 aa, Artificial Sequence
  Description of Artificial Sequence: Synthetic heavy chain variable domain
QVQLVQSGAEVKKPGASVKVSCKASGYTFTSYVMHWVRQAPGQRLEWMGYINPYNDGTKYNEKFKGRVTITSDTSASTAYMELSSLRSEDTAVYYCANYYGSSLSMDYWGQGTLVTVSS

SEQ ID NO: 2588 - protein, 107 aa, Artificial Sequence
  Description of Artificial Sequence: Synthetic heavy chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPYTFGQGTKLEIK

SEQ ID NO: 2589 - protein, 121 aa, Artificial Sequence
  Description of Artificial Sequence: Synthetic heavy chain variable domain
QVQLQESGPGLVKPSQTLSLTCAVYGGSFSSGYWNWIRKHPGKGLEYIGYISYNGITYHNPSLKSRITINRDTSKNQYSLQLNSVTPEDTAVYYCARYRYDYDGGHAMDYWGQGTLVTVSS

SEQ ID NO: 2590 - protein, 119 aa, Artificial Sequence
  Description of Artificial Sequence: Synthetic heavy chain variable domain
QVQLVQSGAEVKKPGASVKVSCKASGYTFTSYVMHWVRQAPGQRLEWIGYINPYNDGTKYNEKFKGRATITSDTSASTAYMELSSLRSEDTAVYYCANYYGSSLSMDYWGQGTLVTVSS

SEQ ID NO: 2591 - protein, 121 aa, Artificial Sequence
  Description of Artificial Sequence: Synthetic heavy chain variable domain
QVQLQESGPGLVKPSQTLSLTCAVYGGSFSSGYWNWIRKHPGKGLEYIGYISYNGITYHNPSLKSRITINPDTSKNQYSLQLNSVTPEDTAVYYCARYRYDYDGGHAMDYWGQGTLVTVSS

SEQ ID NO: 2592 - protein, 119 aa, Artificial Sequence
  Description of Artificial Sequence: Synthetic heavy chain variable domain
QVQLVQSGAEVKKPGASVKVSCKASGYTFTSYVMHWVRQAPGQRLEWIGYINPYNDGTKYNEKFKGRATLTSDKSASTAYMELSSLRSEDTAVYYCANYYGSSLSMDYWGQGTLVTVSS

SEQ ID NO: 2593 - protein, 121 aa, Artificial Sequence
  Description of Artificial Sequence: Synthetic heavy chain variable domain
QVQLVQSGAEVKKPGSSVKVSCKASGYTFKDYTMHWVRQAPGQGLEWMGGIYPNNGGSTYNQNFKDRVTITADKSTSTAYMELSSLRSEDTAVYYCARMGYHGPHLDFDVWGQGTTVTVSS

SEQ ID NO: 2594 - protein, 121 aa, Artificial Sequence
  Description of Artificial Sequence: Synthetic heavy chain variable domain
QVQLQESGPGLVKPSQTLSLTCAVYGGSFSSGYWNWIRKHPGKGLEYIGYISYNAITYHNPSLKSRITINRDTSKNQYSLQLNSVTPEDTAVYYCARYKYDYDAGHAMDYWGQGTLVTVSS

SEQ ID NO: 2595 - protein, 121 aa, Artificial Sequence
  Description of Artificial Sequence: Synthetic heavy chain variable domain
QVQLQESGPGLVKPSQTLSLTCAVYGGSFSSGYWNWIRKHPGKGLEYIGYISYNAITYHNPSLKSRITINRDTSKNQYSLQLNSVTPEDTAVYYCARYRYDYDGGHAMDYWGQGTLVTVSS

SEQ ID NO: 2596 - protein, 121 aa, Artificial Sequence
  Description of Artificial Sequence: Synthetic heavy chain variable domain
QVQLVQSGAEVKKPGSSVKVSCKASGYTFKDYTMHWVRQAPGQGLEWIGGIYPNNGGSTYNQNFKDRVTLTADKSTSTAYMELSSLRSEDTAVYYCARMGYHGPHLDFDVWGQGTTVTVSS

SEQ ID NO: 2597 - protein, 107 aa, Artificial Sequence
  Description of Artificial Sequence: Synthetic heavy chain variable domain
DIQMTQSPSSVSASVGDRVTITCRASQGISSWLAWYQHKPGKAPKLLIYAASSLQSGVPSRFSGSGSGTDFTLTISSLQPEDFATYYCQQANSFPSTFGQGTKVEIK

SEQ ID NO: 2598 - protein, 121 aa, Artificial Sequence
  Description of Artificial Sequence: Synthetic heavy chain variable domain
QVQLVQSGAEVKKPGSSVKVSCKASGYTFKDYTMHWVRQAPGQGLEWIGGIYPNNGGSTYNQNFKDRATLTVDKSTSTAYMELSSLRSEDTAVYYCARMGYHGPHLDFDVWGQGTTVTVSS

SEQ ID NO: 2599 - protein, 121 aa, Artificial Sequence
  Description of Artificial Sequence: Synthetic heavy chain variable domain
QVQLQESGPGLVKPSQTLSLTCAVYGGSFSSGYWNWIRKHPGKGLEYIGYISYNGITYHNPSLKSRITINRDTSKNQYSLQLNSVTPEDTAVYYCARYKYDYDGGHAMDYWGQGTLVTVSS

SEQ ID NO: 2600 - protein, 138 aa, Artificial Sequence
  Description of Artificial Sequence: Synthetic heavy chain variable domain
MYLGLNYVFIVFLLNGVQSEVKLEESGGGLVQPGGSMKLSCAASGFTFSDAWMDWVRQSPEKGLEWVAEIRSKANNHATYYAESVNGRFTISRDDSKSSVYLQMNSLRAEDTGIYYCTWGEVFYFDYWGQGTTLTVSS

SEQ ID NO: 2601 - protein, 121 aa, Artificial Sequence
  Description of Artificial Sequence: Synthetic heavy chain variable domain
QVQLQESGPGLVKPSQTLSLTCAVYGGSFSSGYWNWIRKHPGKGLEYIGYISYSGITYHNPSLKSRITINRDTSKNQYSLQLNSVTPEDTAVYYCARYRYDYDGGHAMDYWGQGTLVTVSS

SEQ ID NO: 2602 - protein, 121 aa, Artificial Sequence
  Description of Artificial Sequence: Synthetic heavy chain variable domain
QVQLQESGPGLVKPSQTLSLTCAVYGGSFSSGYWNWIRKHPGKGLEYIGYISYSGITYHNPSLKSRITINRDTSKNQYSLQLNSVTPEDTAVYYCARYKYDYDGGHAMDYWGQGTLVTVSS

SEQ ID NO: 2603 - protein, 121 aa, Artificial Sequence
  Description of Artificial Sequence: Synthetic heavy chain variable domain
EVQLQESGPSLVKPSQTLSLTCSVTGDSFTSGYWNWIRKFPGNRLEYMGYISYNAITYHNPSLKSRISITRDTSKNHYYLQLNSVTTEDTATYFCARYRYDYDGGHAMDYWGQGTLVTVSS

SEQ ID NO: 2604 - protein, 107 aa, Artificial Sequence [sequence omitted]

SEQ ID NO: 2605 - protein, 121 aa, Artificial Sequence
  Description of Artificial Sequence: Synthetic heavy chain variable domain
QVQLQESGPGLVKPSQTLSLTCAVYGGSFSSGYWNWIRKHPGKGLEYIGYISYNAITYHNPSLKSRITINRDTSKNQYSLQLNSVTPEDTAVYYCARYKYDYDGGHAMDYWGQGTLVTVSS

SEQ ID NO: 2606 - protein, 140 aa, Artificial Sequence
  Description of Artificial Sequence: Synthetic heavy chain variable domain
MEWGPCWVFLVVILEGVQCGVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARGVYHNGWSFFDYWGQGTLLTVSS

SEQ ID NO: 2607 - protein, 451 aa, Artificial Sequence
  Description of Artificial Sequence: Synthetic heavy chain variable domain
QVQLQESGPGLVKPSQTLSLTCAVYGGSFSSGYWNWIRKHPGKGLEYIGYISYNGITYHNPSLKSRITINRDTSKNQYSLQLNSVTPEDTAVYYCARYKYDYDGGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2608 - protein, 107 aa, Artificial Sequence
  Description of Artificial Sequence: Synthetic heavy chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 2609 - protein, 108 aa, Artificial Sequence
  Description of Artificial Sequence: Synthetic heavy chain variable domain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK

SEQ ID NO: 2610 - protein, 117 aa, Artificial Sequence
  Description of Artificial Sequence: Synthetic heavy chain variable domain
EVQLVESGGGLVQPGGSLRLSCAASGFTFTNYGIHWIRQAPGKGLEWVASISPSGGLTYYRDSVKGRFTISRDDAKNSPYLQMNSLRAEDTAVYYCATGGEGIFDYWGQGTLVTVSS

SEQ ID NO: 2611 - protein, 141 aa, Artificial Sequence
  Description of Artificial Sequence: Synthetic heavy chain variable domain
MDTLCSTLLLLTIPSWVLSQITLKESGPTLVKPKQTLTLTCTFSGFSLSTSGMGVGWIRQPPGKALEWLAVIYWDDHQLYSPSLKSRLTITKDTSKNQVVLTMTNMDPVDTATYYCAHRRGAFQHWGQGTLVTVSSASTKG

SEQ ID NO: 2612 - protein, 117 aa, Artificial Sequence
  Description of Artificial Sequence: Synthetic heavy chain variable domain
EAQLVQSGGGLVHPGGSLRLSCADSGFTFSSYAMYWVRQAPGKGLEWVSAIDTDGGTFYADSVRGRFTISRDNAKNSLYLQMNGLRAEDMAVYFCARLGEGYFFDYWGQGTLVTVSS

SEQ ID NO: 2613 - protein, 446 aa, Artificial Sequence
  Description of Artificial Sequence: Synthetic heavy chain variable domain
EVQLVQSGGGLVQPGGSLRLSCAGSGFTFSNYAMYWVRQAPGKGLEWVSAIGIGGDTFYTDSVKGRFTISRDNAKNSLSLQMNSLRAEDTAVYYCARMGTGYFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2614 - protein, 446 aa, Artificial Sequence
  Description of Artificial Sequence: Synthetic heavy chain variable domain
EVQLVQSGGGLVHPGGSLRLSCAGSGFTFSNYAMYWVRQAPGKGLEWVSAIGIGGDTFYTDSVKGRFTISRDNAKNSLSLQMNSLRAEDTAVYYCARYGTGYFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2615 - protein, 444 aa, Artificial Sequence
  Description of Artificial Sequence: Synthetic heavy chain variable domain
QVQLVESGGGVVQPGRSLRLSCAASGFTFSNYALHWVRQAPGKGLEWVALISYDGSRKHYADSVKGRFSISRDNSKNTLYLQMNSLRAEDTAVYYCASLTMVREWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2616 - protein, 113 aa, Artificial Sequence [sequence omitted]

SEQ ID NO: 2617 - protein, 121 aa, Artificial Sequence
  Description of Artificial Sequence: Synthetic heavy chain variable domain
QVQLVQSGAELKQPGASVKMSCKASGYSFTSSWIHWVKQAPGQGLEWIGYIYPSTGFTEYNQKFKDRATLTADKSTSTAYMELSSLRSEDSAVYYCARWRDSSGYHAMDYWGQGTSVTVSS

SEQ ID NO: 2618 - protein, 121 aa, Artificial Sequence
  Description of Artificial Sequence: Synthetic heavy chain variable domain
QVQLVQSGAEVKQPGASVKMSCKASGYSFTSSWIHWVKQAPGQGLEWIGYIYPSTGFTEYNQKFKDRATLTADKSTSTAYMELSSLRSEDTAVYYCARWRDSSGYHAMDYWGQGTSVTVSS

SEQ ID NO: 2619 - protein, 121 aa, Artificial Sequence
  Description of Artificial Sequence: Synthetic heavy chain variable domain
QVQLVQSGHEVKQPGASVKMSCKASGYSFTSSWIHWVKQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 2620 - protein, 121 aa, Artificial Sequence
  Description of Artificial Sequence: Synthetic heavy chain variable domain
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 2621 - protein, 444 aa, Artificial Sequence
  Description of Artificial Sequence: Synthetic heavy chain variable domain
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2622 - protein, 121 aa, Artificial Sequence
  Description of Artificial Sequence: Synthetic heavy chain variable domain
QVQLVQSGHEVKQPGASVKVSCKASGYSFTSSWIHWVRQAPGQGLEWIGYIYPSTGFTEYNQKFKDRATITADKSTSTAYMELSSLRSEDTAVYYCARWRDSSGYHAMDYWGQGTLVTVSS

SEQ ID NO: 2623 - protein, 117 aa, Artificial Sequence
  Description of Artificial Sequence: Synthetic heavy chain variable domain
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLLTGTFAYWGQGTLVTVSS

SEQ ID NO: 2624 - protein, 443 aa, Artificial Sequence
  Description of Artificial Sequence: Synthetic heavy chain variable domain
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 2625 - protein, 117 aa, Artificial Sequence
  Description of Artificial Sequence: Synthetic heavy chain variable domain
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 2626 - protein, 117 aa, Artificial Sequence
  Description of Artificial Sequence: Synthetic heavy chain variable domain
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSS

SEQ ID NO: 2627 - protein, 117 aa, Artificial Sequence
  Description of Artificial Sequence: Synthetic heavy chain variable domain
QVQLVQSGAEVKKPGASVKVSCKASGYTFTSYWINWVRQAPGQGLEWMGNIYPGSSITNYNEKFKNRVTMTRDTSTSTVYMELSSLRSEDTAVYYCARLTTGTFAYWGQGTLVTVSS

SEQ ID NO: 2628 - protein, 117 aa, Artificial Sequence
  Description of Artificial Sequence: Synthetic heavy chain variable domain
EVQLVQSGAEVKKPGESLRISCKGSGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSS

SEQ ID NO: 2629 - protein, 117 aa, Artificial Sequence
  Description of Artificial Sequence: Synthetic heavy chain variable domain
QVQLVQSGAEVKKPGASVKVSCKASGYTFTSYWINWVRQAPGQGLEWMGNIWPGSSLTNYNEKFKNRVTMTRDTSTSTVYMELSSLRSEDTAVYYCARLLTGTFAYWGQGTLVTVSS

SEQ ID NO: 2630 - protein, 117 aa, Artificial Sequence
  Description of Artificial Sequence: Synthetic heavy chain variable domain
QVQLVQSGAEVKKPGASVKVSCKASGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSS

SEQ ID NO: 2631 - protein, 117 aa, Artificial Sequence
  Description of Artificial Sequence: Synthetic heavy chain variable domain
EVQLVQSGAEVKKPGESLRISCKGSGYTFTTYWMHWVRQAPGQGLEWMGNIYPGTGGSNFDEKFKNRFTISRDNSKNTLYLQMNSLRAEDTAVYYCTRWTTGTGAYWGQGTTVTVSS

SEQ ID NO: 2632 - protein, 440 aa, Artificial Sequence
  Description of Artificial Sequence: Synthetic heavy chain variable domain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2633 - protein, 440 aa, Artificial Sequence; identical to SEQ ID NO: 2632
  Description of Artificial Sequence: Synthetic heavy chain variable domain

SEQ ID NO: 2634 - protein, 440 aa, Artificial Sequence; identical to SEQ ID NO: 2632
  Description of Artificial Sequence: Synthetic heavy chain variable domain

SEQ ID NO: 2635 - protein, 447 aa, Artificial Sequence
  Description of Artificial Sequence: Synthetic heavy chain variable domain
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2636 - protein, 447 aa, Artificial Sequence; identical to SEQ ID NO: 2635
  Description of Artificial Sequence: Synthetic heavy chain variable domain

SEQ ID NO: 2637 - protein, 253 aa, Artificial Sequence
  Description of Artificial Sequence: Synthetic heavy chain variable domain
GFGLRWVFLVAILKGVQCEVQLLESGGGLVQPGGSLRLSCAASGFTFSNFGMTWVRQAPGKGLEWVSGVSIRGIATYYADSVKGRFTISRDDSRNTLYLQMNSLRAEDTALYYCATGVRLLGREWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELL

SEQ ID NO: 2638 - protein, 448 aa, Artificial Sequence
  Description of Artificial Sequence: Synthetic heavy chain variable domain
  MOD_RES (403)..(403): Any amino acid
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSIXDSFFLYSKLTVDKSRWQQGNVFSCSVMHEALHNHYTQKSLSLSPG

SEQ ID NO: 2639 - protein, 120 aa, Artificial Sequence
  Description of Artificial Sequence: Synthetic heavy chain variable domain
QVQLVQSGAEVKKPGASVKVSCKASGYTFTSYWMYWVRQATGQGLEWMGRIDPNSGSTKYNEKFKNRFTISRDDSKNTAYLQMNSLKTEDTAVYYCARDYRKGLYAMDYWGQGTTVTVSS

SEQ ID NO: 2640 - protein, 447 aa, Artificial Sequence
  Description of Artificial Sequence: Synthetic heavy chain variable domain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2641 - protein, 120 aa, Artificial Sequence
  Description of Artificial Sequence: Synthetic heavy chain variable domain
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSS

SEQ ID NO: 2642 - protein, 118 aa, Artificial Sequence [sequence omitted]

SEQ ID NO: 2643 - protein, 120 aa, Artificial Sequence
  Description of Artificial Sequence: Synthetic heavy chain variable domain
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSS

SEQ ID NO: 2644 - protein, 120 aa, Artificial Sequence
  Description of Artificial Sequence: Synthetic heavy chain variable domain
EVQLVQSGAEVKKPGATVKISCKVSGYTFTSYWMYWIRQSPSRGLEWLGRIDPNSGSTKYNEKFKNRLTISKDTSKNQVVLTMTNMDPVDTATYYCARDYRKGLYAMDYWGQGTTVTVSS

SEQ ID NO: 2645 - protein, 120 aa, Artificial Sequence
  Description of Artificial Sequence: Synthetic heavy chain variable domain
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSS

SEQ ID NO: 2646 - protein, 120 aa, Artificial Sequence
  Description of Artificial Sequence: Synthetic heavy chain variable domain
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSS

SEQ ID NO: 2647 - protein, 120 aa, Artificial Sequence
  Description of Artificial Sequence: Synthetic heavy chain variable domain
EVQLVQSGAEVKKPGESLRISCKGSGYTFTSYWMYWVRQARGQRLEWIGRIDPNSGSTKYNEKFKNRLTISKDTSKNQVVLTMTNMDPVDTATYYCARDYRKGLYAMDYWGQGTTVTVSS

SEQ ID NO: 2648 - protein, 118 aa, Artificial Sequence [sequence omitted]

SEQ ID NO: 2649 - protein, 120 aa, Artificial Sequence
  Description of Artificial Sequence: Synthetic heavy chain variable domain
QITLKESGPTLVKPTQTLTLTCTFSGYTFTSYWMYWVRQAPGKGLEWVSRIDPNSGSTKYNEKFKNRVTITADKSTSTAYMELSSLRSEDTAVYYCARDYRKGLYAMDYWGQGTTVTVSS

SEQ ID NO: 2650 - protein, 120 aa, Artificial Sequence
  Description of Artificial Sequence: Synthetic heavy chain variable domain
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSS

SEQ ID NO: 2651 - protein, 122 aa, Artificial Sequence
  Description of Artificial Sequence: Synthetic heavy chain variable domain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTK

SEQ ID NO: 2652 - protein, 120 aa, Artificial Sequence
  Description of Artificial Sequence: Synthetic heavy chain variable domain
EVQLQQSGAELVKPGASVKLSCKASGYTFTSYWMYWVKQGPGRGLEWIGRIDPNSGSTKYNEKFKNKATLTVDKSSSTAYMQLSSLTSEDSAVYYCARDYRKGLYAMDYWGQGTTVTVSS

SEQ ID NO: 2653 - protein, 120 aa, Artificial Sequence; identical to SEQ ID NO: 2639
  Description of Artificial Sequence: Synthetic heavy chain variable domain

SEQ ID NO: 2654 - protein, 446 aa, Artificial Sequence
  Description of Artificial Sequence: Synthetic heavy chain variable domain
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 2655 - protein, 447 aa, Artificial Sequence
  Description of Artificial Sequence: Synthetic heavy chain variable domain
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2656 - protein, 98 aa, Artificial Sequence
  Description of Artificial Sequence: Synthetic heavy chain variable domain
QVQLQQPGAELVKPGASVKLSCKASGYTFTSYWMHWVKQRPGRGLEWIGRIDPNSGGTKYNEKFKSKATLTVDKPSSTAYMQLSSLTSEDSAVYYCAR

SEQ ID NO: 2657 - protein, 113 aa, Artificial Sequence
  Description of Artificial Sequence: Synthetic heavy chain variable domain
EVQLQQSGAELVKPGASVKLSCKASGYTFTSYWMYWVKQGPGRGLEWIGRIDPNSGSTKYNEKFKNKATLTVDKSSSTAYMQLSSLTSEDSAVYYCARDYRKGLYAMDYWGQG

SEQ ID NO: 2658 - protein, 113 aa, Artificial Sequence
  Description of Artificial Sequence: Synthetic heavy chain variable domain
QVQLVQSGAEVKKPGASVKVSCKASGYTFTSYWMYWVRQATGQGLEWMGRIDPNSGSTKYNEKFKNRFTISRDDSKNTAYLQMNSLKTEDTAVYYCARDYRKGLYAMDYWGQG

SEQ ID NO: 2659 - protein, 113 aa, Artificial Sequence
  Description of Artificial Sequence: Synthetic heavy chain variable domain
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQG

SEQ ID NO: 2660 - protein, 113 aa, Artificial Sequence
  Description of Artificial Sequence: Synthetic heavy chain variable domain
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQG

SEQ ID NO: 2661 - protein, 113 aa, Artificial Sequence
  Description of Artificial Sequence: Synthetic heavy chain variable domain
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQG

SEQ ID NO: 2662 - protein, 113 aa, Artificial Sequence
  Description of Artificial Sequence: Synthetic heavy chain variable domain
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQG

SEQ ID NO: 2663 - protein, 113 aa, Artificial Sequence
  Description of Artificial Sequence: Synthetic heavy chain variable domain
EVQLVQSGAEVKKPGESLRISCKGSGYTFTSYWMYWVRQARGQRLEWIGRIDPNSGSTKYNEKFKNRLTISKDTSKNQVVLTMTNMDPVDTATYYCARDYRKGLYAMDYWGQG

SEQ ID NO: 2664 - protein, 113 aa, Artificial Sequence
  Description of Artificial Sequence: Synthetic heavy chain variable domain
EVQLVQSGAEVKKPGATVKISCKVSGYTFTSYWMYWIRQSPSRGLEWLGRIDPNSGSTKYNEKFKNRLTISKDTSKNQVVLTMTNMDPVDTATYYCARDYRKGLYAMDYWGQG

SEQ ID NO: 2665 - protein, 113 aa, Artificial Sequence
  Description of Artificial Sequence: Synthetic heavy chain variable domain
QITLKESGPTLVKPTQTLTLTCTFSGYTFTSYWMYWVRQAPGKGLEWVSRIDPNSGSTKYNEKFKNRVTITADKSTSTAYMELSSLRSEDTAVYYCARDYRKGLYAMDYWGQG

SEQ ID NO: 2666 - protein, 113 aa, Artificial Sequence
  Description of Artificial Sequence: Synthetic heavy chain variable domain
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQG

SEQ ID NO: 2667 - protein, 446 aa, Artificial Sequence
  Description of Artificial Sequence: Synthetic heavy chain variable domain
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 2668 - protein, 120 aa, Artificial Sequence; identical to SEQ ID NO: 2641
  Description of Artificial Sequence: Synthetic heavy chain variable domain

SEQ ID NO: 2669 - protein, 118 aa, Artificial Sequence
  Description of Artificial Sequence: Synthetic heavy chain variable domain
EVQLLESGGGLVQPGGSLRLSCAASGFTFSSYIMMWVRQAPGKGLEWVSSIYPSGGITFYADKGRFTISRDNSKNTLYLQMNSLRAEDTAVYYCARIKLGTVTTVDYWGQGTLVTVSS

SEQ ID NO: 2670 - protein, 253 aa, Artificial Sequence [sequence omitted]

SEQ ID NO: 2671 - protein, 117 aa, Artificial Sequence
  Description of Artificial Sequence: Synthetic heavy chain variable domain
EVQLLESGGGLVQPGGSLRLSCAASGFTFSSYAMSWVRQAPGKGLEWVSGIGSYGGGTYYADSVKGRFTISRDNSKNTLYLQMNSLRAEDTAVYYCARYVNFGMDYWGQGTLVTVSS

SEQ ID NO: 2672 - protein, 116 aa, Artificial Sequence
  Description of Artificial Sequence: Synthetic heavy chain variable domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARRVWGFDYWGQGTLVTVSS

SEQ ID NO: 2673 - protein, 447 aa, Artificial Sequence
  Description of Artificial Sequence: Synthetic heavy chain variable domain
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2674 - protein, 128 aa, Artificial Sequence
  Description of Artificial Sequence: Synthetic heavy chain variable domain
  MOD_RES (120)..(120): Any amino acid
  MOD_RES (124)..(125): Any amino acid
EVRLQQSGADLVKPGASVKLSCASGFIIKATYMHWVRQRPEQGLEWIGRIDPANGEKYDPKFQVKAITADTSSSTAYLQLNSLTSDDTAVYYCARYAWYFDVWGAGTTVTVSSAKTTPPXVYPXXPGS

SEQ ID NO: 2675 - protein, 446 aa, Artificial Sequence
  Description of Artificial Sequence: Synthetic heavy chain variable domain
EVQLVESGGDLVQPGGSLRLSCAASGFTFSSYWMSWVRQAPGKGLEWVANIKQDGSEKYYVDSVKGRFTISRDNAKNSLYLQMNSLRAEDTAVYYCARDRGSLYYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2676 - protein, 124 aa, Artificial Sequence
  Description of Artificial Sequence: Synthetic heavy chain variable domain
QVQLQQSGPGLVKPSQTLSLTCAISGDSVSSNSAAWGWIRQSPGRGLEWLGRIYYRSKWYNSYAVSVKSRITINPDTSKNQFSLQLNSVTPEDTAVYYCARYDWVPKIGVFDSWGQGTLVTVSS

SEQ ID NO: 2677 - protein, 120 aa, Artificial Sequence; identical to SEQ ID NO: 2643
  Description of Artificial Sequence: Synthetic heavy chain variable domain

SEQ ID NO: 2678 - protein, 447 aa, Artificial Sequence
  Description of Artificial Sequence: Synthetic heavy chain variable domain
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2679 - protein, 120 aa, Artificial Sequence; identical to SEQ ID NO: 2644
  Description of Artificial Sequence: Synthetic heavy chain variable domain

SEQ ID NO: 2680 - protein, 447 aa, Artificial Sequence
  Description of Artificial Sequence: Synthetic heavy chain variable domain
EVQLVQSGAEVKKPGATVKISCKVSGYTFTSYWMYWIRQSPSRGLEWLGRIDPNSGSTKYNEKFKNRLTISKDTSKNQVVLTMTNMDPVDTATYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2681 - protein, 120 aa, Artificial Sequence; identical to SEQ ID NO: 2645
  Description of Artificial Sequence: Synthetic heavy chain variable domain

SEQ ID NO: 2682 - protein, 447 aa, Artificial Sequence
  Description of Artificial Sequence: Synthetic heavy chain variable domain
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2683 - protein, 120 aa, Artificial Sequence; identical to SEQ ID NO: 2646
  Description of Artificial Sequence: Synthetic heavy chain variable domain

SEQ ID NO: 2684 - protein, 120 aa, Artificial Sequence
  Description of Artificial Sequence: Synthetic heavy chain variable domain
QVHLQQPGAELVKPGASVKLSCKASGYTFTSYWMYWVKQGPGRGLEWIGRIDPNSGSTKYNEKFKNKATLTVDKSSSTAYMQLSSLTSEDSAVYYCARDYRKGLYAMDYWGQGTSVTVSS

SEQ ID NO: 2685 - protein, 120 aa, Artificial Sequence; identical to SEQ ID NO: 2647
  Description of Artificial Sequence: Synthetic heavy chain variable domain

SEQ ID NO: 2686 - protein, 120 aa, Artificial Sequence; identical to SEQ ID NO: 2649
  Description of Artificial Sequence: Synthetic heavy chain variable domain

SEQ ID NO: 2687 - protein, 447 aa, Artificial Sequence
  Description of Artificial Sequence: Synthetic heavy chain variable domain
QITLKESGPTLVKPTQTLTLTCTFSGYTFTSYWMYWVRQAPGKGLEWVSRIDPNSGSTKYNEKFKNRVTITADKSTSTAYMELSSLRSEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2688 - protein, 120 aa, Artificial Sequence; identical to SEQ ID NO: 2650
  Description of Artificial Sequence: Synthetic heavy chain variable domain

SEQ ID NO: 2689 - protein, 446 aa, Artificial Sequence
  Description of Artificial Sequence: Synthetic heavy chain variable domain
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 2690 - protein, 446 aa, Artificial Sequence
  Description of Artificial Sequence: Synthetic heavy chain variable domain
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 2691 - protein, 446 aa, Artificial Sequence; identical to SEQ ID NO: 2654
  Description of Artificial Sequence: Synthetic heavy chain variable domain

SEQ ID NO: 2692 - protein, 112 aa, Artificial Sequence
  Description of Artificial Sequence: Synthetic heavy chain variable domain
QVQLVQSGAELKKPGASVKMSCKASGYTFTGYTMHWVKQAPGQGLEWIGYINPRSGYTEYNQKFKDRTTLTADKSTSTAYMELSSLRSEDSAVYYCARPWFAYWGQGTLVTV

SEQ ID NO: 2693 - protein, 114 aa, Artificial Sequence
  Description of Artificial Sequence: Synthetic heavy chain variable domain
QVQLVQSGAEVKKPGASVKMSCKASGYTFTGYTMHWVKQAPGQGLEWIGYINPRSGYTEYNQKFKDRTTLTADKSTSTAYMELSSLRSEDTAVYYCARPWFAYWGQGTLVTVSS

SEQ ID NO: 2694 - protein, 114 aa, Artificial Sequence
  Description of Artificial Sequence: Synthetic heavy chain variable domain
QVQLVQSGAEVKKPGASVKMSCKASGYTFTGYTMHWVRQAPGQGLEWIGYINPRSGYTEYNQKFKDRTTLTADKSTSTAYMELSSLRSEDTAVYYCARPWFAYWGQGTLVTVSS

SEQ ID NO: 2695 - protein, 114 aa, Artificial Sequence
  Description of Artificial Sequence: Synthetic heavy chain variable domain
QVQLVQSGAEVKKPGASVKVSCKASGYTFTGYTMHWVRQAPGQGLEWIGYINPRSGYTEYNQKFKDRTTLTADKSTSTAYMELSSLRSEDTAVYYCARPWFAYWGQGTLVTVSS

SEQ ID NO: 2696 - protein, 137 aa, Artificial Sequence
  Description of Artificial Sequence: Synthetic heavy chain variable domain
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSS

SEQ ID NO: 2697 - protein, 136 aa, Artificial Sequence
  Description of Artificial Sequence: Synthetic heavy chain variable domain
QRLVESGGGVVQPGSSLRLSCAASGFDFSRQGMHWVRQAPGQGLEWVAFIKYDGSEKYHADSVWGRLSISRDNSKDTLYLQMNSLRVEDTATYFCVREAGGPDYRNGYNYYDFYDGYYNYHYMDVWGKGTTVTVSS

SEQ ID NO: 2698 - protein, 141 aa, Artificial Sequence
  Description of Artificial Sequence: Synthetic heavy chain variable domain
QVQLVQSGPEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSS

SEQ ID NO: 2699 - protein, 141 aa, Artificial Sequence
  Description of Artificial Sequence: Synthetic heavy chain variable domain
QVQLVQSGPEVKKPGSSVKVSCKASGNTFSKYDVHWVRQATGQGLEWVGWISHERDKTESAQRFKGRVTFTRDTSATTAYMELRGLTSDDTAIYYCTRGSKHRLRDYVLYDDYGLINYQEWNDYLEFLDVWGHGTAVTVSS

SEQ ID NO: 2700 - protein, 141 aa, Artificial Sequence
  Description of Artificial Sequence: Synthetic heavy chain variable domain
QVQLEQSGAEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSS

SEQ ID NO: 2701 - protein, 141 aa, Artificial Sequence
  Description of Artificial Sequence: Synthetic heavy chain variable domain
QVQLVQSGAEVKKPGSSVKVSCKASGNTFRKYDVHWVRQATGQGLEWVGWMSHEGDKTESAQRFKGRVSFTRDNSASTAYIELRGLTSDDTAIYYCTGGSKHRLRDYVLYDDYGLINQQEWNDYLEFLDVWGHGTAVTVSS

SEQ ID NO: 2702 - protein, 140 aa, Artificial Sequence
  Description of Artificial Sequence: Synthetic heavy chain variable domain
QVQLVQSGAEVKKPGSSVKVSCKASGNSFSNHDVHWVRQATGQGLEWMGWMSHEGDKTGLAQKFQGRVTITRDSGASTVYMELRGLTADDTAIYYCLTGSKHRLRDYFLYNEYGPNYEEWGDYLATLDVWGHGTAVTVSS

SEQ ID NO: 2703 - protein, 112 aa, Artificial Sequence
  Description of Artificial Sequence: Synthetic heavy chain variable domain
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 2704 - protein, 112 aa, Artificial Sequence
  Description of Artificial Sequence: Synthetic heavy chain variable domain
QSVVTQPPAVSGALGQRVTISCTGTTSNIGAGFDVHWYQQRPGAAPKLLISGNTHRPSGVPDRISGSKSGTLASLAITGLQAEDEADYYCQSYDRSLSTILFGGGTKLTVLG

SEQ ID NO: 2705 - protein, 112 aa, Artificial Sequence
  Description of Artificial Sequence: Synthetic heavy chain variable domain
QSVLTQPPSVSGAPGQRVTISCTGSSSNIGAGFDVHWYQQLPGTAPKLLIFGNSNRPSGVPDRFSGSKSGTSASLAITGLQAEDEADYYCQSYDSSLSGYVFGSGTKVTVLG

SEQ ID NO: 2706 - protein, 108 aa, Artificial Sequence
  Description of Artificial Sequence: Synthetic heavy chain variable domain
DIQLTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIKR

SEQ ID NO: 2707 - protein, 111 aa, Artificial Sequence
  Description of Artificial Sequence: Synthetic heavy chain variable domain
KLLPVLTQPPSVSVAPGKTARITCGGNNIGSKSVHWYQQKPGQAPVLVIYYDSDRPSGIPERFSGSNSGNTATLTISRVEAGDEADYYCQVWDSITDHYVFGTGTKVTVLG

SEQ ID NO: 2708 - protein, 113 aa, Artificial Sequence
  Description of Artificial Sequence: Synthetic heavy chain variable domain
KLLPVLTQPHSVSESPGKTVTISCTGSSGSIASNFVQWYQQRPGSAPTTVIYDDNQRPSGVPDRFSASIDRSSNSASLTISGLKTDDEADYYCQSYDGSNVIFGGGTKLTVLG

SEQ ID NO: 2709 - protein, 109 aa, Artificial Sequence
  Description of Artificial Sequence: Synthetic heavy chain variable domain
QPVLTQPPSVSVAPGETASVSCGGNNFGSQSVHWYQQKSGQAPLLVIYYDQDRPSEIPARFSGSKSGNTATLTISRVEAGDEADYYCQVWDTYTDHVVFGGGTKLTVLG

SEQ ID NO: 2710 - protein, 215 aa, Artificial Sequence
  Description of Artificial Sequence: Synthetic heavy chain variable domain
EVQLQQSGGELVKPGSSVKISCKASRNTFTDYNLDWVKQSHGKTLEWIGNVYPNNGVTGYNQKFRGKATLTVDKSSSTAYMELHSLTSEDSAIYYCALYYYDVSYWGQGTLVTVSSAKTTPPSVYPLAPGSAAQTSMVTLGCLVKGYFPEPVTVTWNSGSLSSGVHTFPAVLQSDLYTLSSSVTVPSSTWPSQSVTCNVAHPASSTKVDKKITPR

SEQ ID NO: 2711 - protein, 115 aa, Artificial Sequence
  Description of Artificial Sequence: Synthetic heavy chain variable domain
EVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSS

SEQ ID NO: 2712 - protein, 113 aa, Artificial Sequence
  Description of Artificial Sequence: Synthetic heavy chain variable domain
QVQMQQSGAELMKPGASVKLSCKATGYTFTGYWIEWVKQRPGHGLEWIGEILPGSGRSNSNEKFKGKATFTADTSSNTAYMQLSSLTTEDSAIYYCARGKLSWGQGTLVTVSA

SEQ ID NO: 2713 - protein, 115 aa, Artificial Sequence
  Description of Artificial Sequence: Synthetic heavy chain variable domain
QVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSA

SEQ ID NO: 2714 - protein, 123 aa, Artificial Sequence
  Description of Artificial Sequence: Synthetic heavy chain variable domain
SDVQLQESGPGLVKPSQSLSLTCTVTGYSITSDYAWNWIRQFPGNKLEWMVSYSGYTNYNPSLKSRISITRDTSKNQFFLQLISVTTEDTATYYCARGDAYDVRRSTYYFDYWGQGTTLTVSS

SEQ ID NO: 2715 - protein, 114 aa, Artificial Sequence
  Description of Artificial Sequence: Synthetic heavy chain variable domain
QLEESGAELMQPGASVKVSCKATLEEGYTFTVYWIEWVKQRPGHGLEWIGEILPGSGSTDYNEKFKGKATFTADSSSNTAYMQLSSLTTEDSAIYYCARGKLHWGQGTLVTVSA

SEQ ID NO: 2716 - protein, 118 aa, Artificial Sequence
  Description of Artificial Sequence: Synthetic heavy chain variable domain
EVKLLESGGGLVQPGGSLKLSCAASGFDFSKDWMSWVRQAPGKGLEWIGEINPDSRTINYAPSLKDKFIISRENAKNTLYLQMSKVRSEDTALYYCARWDYDGGMDYWGQGTSVTVSS

SEQ ID NO: 2717 - protein, 118 aa, Artificial Sequence
  Description of Artificial Sequence: Synthetic heavy chain variable domain
EVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYGNLFAYWGQGTLVTVSA

SEQ ID NO: 2718 - protein, 122 aa, Artificial Sequence
  Description of Artificial Sequence: Synthetic heavy chain variable domain
EVQLQQSGPELVKPGASVKMSCKASGYTFTSYVIHWVKQKPGQGLEWIGYIINPFSDGTKFTEKFKGKASLTSDKSSSTAYMELNSLTSEDSAVYYCARRGPYYYGTAMDYWGQGTSVTVSS

SEQ ID NO: 2719 - protein, 122 aa, Artificial Sequence
  Description of Artificial Sequence: Synthetic heavy chain variable domain
QVQLQQSGAELGRPGASVKLSCKDSGYTITIYWMQWVKQRPGQGLEWIGAIYPGDGDTRYPQKFKGKSTLSADKSSNTASMHLSSLASDDSAVYYCSRGGSTNYDYDGFAYWGQGTLVTVSA

SEQ ID NO: 2720 - protein, 113 aa, Artificial Sequence
  Description of Artificial Sequence: Synthetic heavy chain variable domain
QVQLQQSGAELMKPGASVKISCKATGYTFSNYWIEWVKQRPGHGLEWIGEILPGRGSTNYNEKFKGKATFTADTSSNTAYMQLSSLTSEDSAVYYCARGKQYWGQGTTLTVSS

SEQ ID NO: 2721 - protein, 120 aa, Artificial Sequence
  Description of Artificial Sequence: Synthetic heavy chain variable domain
QVQLQQPGAELVKPGASVKLSCKASGYTFTSYWMHWVKQRPGQGLEWIGEINPSNGRSNYNEKFKSKATLTVDKSSSTAYMQLSSLTSEDSAVYFCAHYYDGSYGFFDYWGQGTTLTVSS

SEQ ID NO: 2722 - protein, 118 aa, Artificial Sequence
  Description of Artificial Sequence: Synthetic heavy chain variable domain
EVKLLESGGGLVQPGGSLKVSCTASGFDFSRYWMSWVRQAPGKGLEWIGEINPDSSTINYTPSLKDKFIISRDNAKNTLYLQMSKVRSEDTALYYCARPGYGNLFVYWGQGTLVTVSS

SEQ ID NO: 2723 - protein, 116 aa, Artificial Sequence
  Description of Artificial Sequence: Synthetic heavy chain variable domain
EVKLLESGGGLVQPGGSLRLSCAASGFDFSKDWMSWVRQAPGKGLEWIGEINPDSSTINYAPALKDKFIISRENAKNTLYLQMNKVRSEDTALYYCARWSTGLDYWGQGTTLTVSS

SEQ ID NO: 2724 - protein, 116 aa, Artificial Sequence
  Description of Artificial Sequence: Synthetic heavy chain variable domain
QVQLQQSGPELVKPGASVKISCKASGYPFSTSWMNWVKQRPGKGLEWIGRIYLGDGDTNYNGKFTGKATLTADKSSSTVYMQLSSLTSEDSAVYFCARWRGDYDYWGQGTTLTVSS

SEQ ID NO: 2725 - protein, 118 aa, Artificial Sequence
  Description of Artificial Sequence: Synthetic heavy chain variable domain
SDVQLQESGPGLVKPSQTLSLTCSVPDYSITSDYHWHWIRQFPGNKLEWMGYISSRGSTNYNPSLKNRISITHDTSENQFFLKLTSVTTEDSATYYCAGLSQLALDYWGQGTTLTVSS

SEQ ID NO: 2726 - protein, 120 aa, Artificial Sequence
  Description of Artificial Sequence: Synthetic heavy chain variable domain
QVTLKESGPGILKPSQTLSLTCSFSGFSLSTSNMGVGWIRQPSGKGLEWLAHIWWDDDKYYNPSLKSQLTISKDTSRNQVFLKITSVDTEDTATYYCVRSNYGYAWFAYWGQGTLVTVSA

SEQ ID NO: 2727 - protein, 119 aa, Artificial Sequence
  Description of Artificial Sequence: Synthetic heavy chain variable domain
QVQLQQSGPEVVRPGVSVKISCKGSGYTFTDYAVHWVKLSHAKSLEWIGVISTYNDYTYNNQDFKGKATMTVDKSSSTAYMELARLTSEDSAIYYCARGNSYFYALDYWGQGTSVTVSS

SEQ ID NO: 2728 - protein, 121 aa, Artificial Sequence
  Description of Artificial Sequence: Synthetic heavy chain variable domain
QVQLQQSGAELASPGTSVKLSCKASGYTFTFYGISWVKQKTGQGLEWIGEIYPGSYNAYYNDKFKGKATLTADRSSSTAYMQLSSLTSEDSAVYFCARDYGDPYYYAMDYWGQGTSVTVSS

SEQ ID NO: 2729 - protein, 118 aa, Artificial Sequence
  Description of Artificial Sequence: Synthetic heavy chain variable domain
EVKLLESGGGLVQPGGSQKLSCAASGFDFSRYWMSWVRQAPGKGLEWIGEINPDSSTVNYTPSLKDKFIISRDNAKNTLYLQMSKVRSEDTALYYCARPGYGNLFVYWGQGTLVTVSA

SEQ ID NO: 2730 - protein, 118 aa, Artificial Sequence
  Description of Artificial Sequence: Synthetic heavy chain variable domain
EVQLQQSGAESVRSGASVKLSCTASGLNIKDYYMHWVNLRPEQGLEWIGWIDPENGDTEYAPEFQGKATMTADTSSNTAYLQLSSLTSEDTAVYYCNACNYGSAYGYWGQGTTLTVSS

SEQ ID NO: 2731 - protein, 120 aa, Artificial Sequence
  Description of Artificial Sequence: Synthetic heavy chain variable domain
EVKLLESGGGLVQPGGSLKLSCAASGFDFSRYWMSWVRQAPGKGLEWIGDLNPDSSAINYTPSLKDKFIISRDNAKNTLYLQMSKVRSEDTALYYCTLITTLVPYTMDFWGQGTSVTVSS

SEQ ID NO: 2732 - protein, 120 aa, Artificial Sequence
  Description of Artificial Sequence: Synthetic heavy chain variable domain
EIHLVESGGGLVKPGGSLKVSCAASGFTFSRYAMSWVRQTPEKRLEWVATISGGGRYTYYPDLVKGRFTISRDIARTTLYLQMSSLRSEDTAMYYCARTARASNYAMDYWGQGTSVTVSS

SEQ ID NO: 2733 - protein, 120 aa, Artificial Sequence
  Description of Artificial Sequence: Synthetic heavy chain variable domain
QITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSS

SEQ ID NO: 2734 - protein, 119 aa, Artificial Sequence
  Description of Artificial Sequence: Synthetic heavy chain variable domain
QVQLVQSGPEVKKPGASVKVSCKASGYTFTDYAVHWVRQAPGKRLEWIGVISTYNDYTYNNQDFKGRVTMTRDTSASTAYMELSRLRSEDTAVYYCARGNSYFYALDYWGQGTSVTVSS

SEQ ID NO: 2735 - protein, 118 aa, Artificial Sequence
  Description of Artificial Sequence: Synthetic heavy chain variable domain
QVQLVQSGAEVKKPGASVKVSCKASGYTFKDYYMHWVRQAPGQGLEWMGWIDPENGDTEYAPEFQGRVTMTRDTSTSTVYMELSSLRSEDTAVYYCNACNYGSAYGYWGQGTTLTVSS

SEQ ID NO: 2736 - protein, 120 aa, Artificial Sequence
  Description of Artificial Sequence: Synthetic heavy chain variable domain
EVQLVESGGGLVQPGGSLRLSCAASGFDFSRYWMSWVRQAPGKGLEWIGDLNPDSSAINYVDSVKGRFTISRDNAKNSLYLQMNSLRAEDTAVYYCTLITTLVPYTMDFWGQGTSVTVSS

SEQ ID NO: 2737 - protein, 117 aa, Artificial Sequence
  Description of Artificial Sequence: Synthetic heavy chain variable domain
QVQLVQSGAEVKKPGSSVKVSCKASGGTFSSYTINWVRQAPGQGLEWMGGFIPISGTVNYAQKFQGRVTITADESTSTAYMELSSLRSEDTAVYYCARPLDWTEDIWGQGTLVTVSS

SEQ ID NO: 2738 - protein, 116 aa, Artificial Sequence
  Description of Artificial Sequence: Synthetic heavy chain variable domain
QVQLQQWGAGLLKPSETLSLTCAVYGGSFSGYYWSWIRQSPGKGLEWIGEVNHSGNTNYNPSLKSRVTISLDTSKNQFSLKLNSVTAADTAVYYCARYFPPMIDVWGQGTLVTVSS

SEQ ID NO: 2739 - protein, 122 aa, Artificial Sequence
  Description of Artificial Sequence: Synthetic heavy chain variable domain
QLQLQESGPGLVKPSETLSLSCTVSGGSISSSSYYWGWIRQPPGKGLEWIGEINHSGSTNYNPSLKSRVTISVDTSKNQFSLKLSSVTAADTAVYYCARYSHHVDSGGYDVWGQGTLVTVSS

SEQ ID NO: 2740 - protein, 117 aa, Artificial Sequence
  Description of Artificial Sequence: Synthetic heavy chain variable domain
EVQLVESGAEVKEPGSSVKVSCKASGGTFSSYGISWIRQAPGQGLEWMGEIIPIFGTPNYAQKFQGRVTITADESTSTAYVELSSLRSDDTAVYYCARSYYGYFDGWGQGTLVTVSS

SEQ ID NO: 2741 - protein, 118 aa, Artificial Sequence
  Description of Artificial Sequence: Synthetic heavy chain variable domain
QVQLVQSGAEVKKPGSSVKVSCKASGGTFSSYAISWVRQAPGQGLEWMGGIIPIFGKGNYPQKFQGRVTITADESTGTAYMELSSLRSEDTAVYYCARHIPTFSFDYWGQGTLVTVSS

SEQ ID NO: 2742 - protein, 118 aa, Artificial Sequence
  Description of Artificial Sequence: Synthetic heavy chain variable domain
EVQLVESGAEVKKPGASVKISCKASGYTFTSYYMHWVRQAPGQGLEWMGIINPSGGSTSYAQKFQGRVTMTRDTSTSTVYMELSSLRSEDTAVYYCARSMYQYFLDSWGQGTLVTVSS

SEQ ID NO: 2743 - protein, 117 aa, Artificial Sequence
  Description of Artificial Sequence: Synthetic heavy chain variable domain
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPRTFGGGTKLEIKRQQGNTLPRT

SEQ ID NO: 2744 - protein, 119 aa, Artificial Sequence
  Description of Artificial Sequence: Synthetic heavy chain variable domain
QVQLKESGPGLVAPSQSLSITCTVSGFSLTGYGVNWVRQPPGKGLEWLGMIWVDGGTDYNSALKSRLSISKDNSKSQVFLKMNSLQTDDTARYYCARGGSSLLGFAYWGQGTLVTVSAA

SEQ ID NO: 2745 - protein, 224 aa, Artificial Sequence
  Description of Artificial Sequence: Synthetic heavy chain variable domain
QVQLQQPGGGLVKPGASVKMSCKASGYTFTSYNMHWVKQTPGRGLEWIGAIYPGNGDTSYNQKFKGKATLTADKSSSTAYMQLSSLTSEDSAIYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2746 - protein, 118 aa, Artificial Sequence
  Description of Artificial Sequence: Synthetic heavy chain variable domain
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSA

SEQ ID NO: 2747 - protein, 119 aa, Artificial Sequence
  Description of Artificial Sequence: Synthetic heavy chain variable domain
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSS

SEQ ID NO: 2748 - protein, 117 aa, Artificial Sequence
  Description of Artificial Sequence: Synthetic heavy chain variable domain
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSS

SEQ ID NO: 2749 - protein, 119 aa, Artificial Sequence
  Description of Artificial Sequence: Synthetic heavy chain variable domain
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSS

SEQ ID NO: 2750 - protein, 118 aa, Artificial Sequence
  Description of Artificial Sequence: Synthetic heavy chain variable domain
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSS

SEQ ID NO: 2751 - protein, 114 aa, Artificial Sequence
  Description of Artificial Sequence: Synthetic heavy chain variable domain
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSS

SEQ ID NO: 2752 - protein, 119 aa, Artificial Sequence
  Description of Artificial Sequence: Synthetic heavy chain variable domain
EVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSA

SEQ ID NO: 2753 - protein, 118 aa, Artificial Sequence
  Description of Artificial Sequence: Synthetic heavy chain variable domain
  MOD_RES (3)..(3): Any amino acid
  MOD_RES (60)..(60): Any amino acid
  MOD_RES (92)..(92): Any amino acid
EVXLVESGGGLVKPGGSLRLSCAASGFTFSSYAMSWVRQAPGKGLEWVASISTGASAYFXDSVKGRFTISRDNAKNSLYLQMNSLRAEDTAXYYCARITTSTWYFDVWGQGTTVTVSS

SEQ ID NO: 2754 - protein, 119 aa, Artificial Sequence; identical to SEQ ID NO: 2747
  Description of Artificial Sequence: Synthetic heavy chain variable domain

SEQ ID NO: 2755 - protein, 117 aa, Artificial Sequence
  Description of Artificial Sequence: Synthetic heavy chain variable domain
  MOD_RES (5)..(5): Any amino acid
  MOD_RES (13)..(13): Any amino acid
  MOD_RES (61)..(61): Any amino acid
  MOD_RES (88)..(88): Any amino acid
  MOD_RES (92)..(92): Any amino acid
QVQLXESGPGLVXPSETLSLTCTVSGFSLTSYGVHWVRQPPGKGLEWLGVIWAGGFTNYNXSLKSRLTISKDNSKNQVSLKLSSVTAXDTAXYYCARRGSSYSMDYWGQGTLVTVSS

SEQ ID NO: 2756 - protein, 118 aa, Artificial Sequence; identical to SEQ ID NO: 2750
  Description of Artificial Sequence: Synthetic heavy chain variable domain

SEQ ID NO: 2757 - protein, 118 aa, Artificial Sequence
  Description of Artificial Sequence: Synthetic heavy chain variable domain
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSS

SEQ ID NO: 2758 - protein, 119 aa, Artificial Sequence; identical to SEQ ID NO: 2752
  Description of Artificial Sequence: Synthetic heavy chain variable domain

SEQ ID NO: 2759 - protein, 118 aa, Artificial Sequence; identical to SEQ ID NO: 2746
  Description of Artificial Sequence: Synthetic heavy chain variable domain

SEQ ID NO: 2760 - protein, 119 aa, Artificial Sequence; identical to SEQ ID NO: 2747
  Description of Artificial Sequence: Synthetic heavy chain variable domain

SEQ ID NO: 2761 - protein, 117 aa, Artificial Sequence; identical to SEQ ID NO: 2748
  Description of Artificial Sequence: Synthetic heavy chain variable domain

SEQ ID NO: 2762 - protein, 116 aa, Artificial Sequence
  Description of Artificial Sequence: Synthetic heavy chain variable domain
QVQLQESGPGLVKPSQTLSLTCTVSGYAFTAYNIHWVRQAPGQGLEWMGSFDPYDGGSSYNQKFKDRLTISKDTSKNQVVLTMTNMDPVDTATYYCARGWYYFDYWGHGTLVTVSS

SEQ ID NO: 2763 - protein, 116 aa, Artificial Sequence
  Description of Artificial Sequence: Synthetic heavy chain variable domain
QVQLQESGPGLVKPSQTLSLTCTVSGYAFTAYNIHWIRQPPGKGLEWIGSFDPYDGGSSYNQKFKDRLTISKDTSKNQVVLTMTNMDPVDTATYYCARGWYYFDYWGHGTLVTVSS

SEQ ID NO: 2764 - protein, 122 aa, Artificial Sequence
  Description of Artificial Sequence: Synthetic heavy chain variable domain
QITLKESGGGLVKPGGSLRLSCAASGFTFSNAWMSWVRQAPGKGLEWVGRIRSKTDGGTTDYAALVKGRFTISRDDSENTLYLQMNSLKTEDTAVYYCARDFGRWSYYFDYWSQGTLVTVSS

SEQ ID NO: 2765 - protein, 122 aa, Artificial Sequence
  Description of Artificial Sequence: Synthetic heavy chain variable domain
QITLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSS

SEQ ID NO: 2766 - protein, 122 aa, Artificial Sequence
  Description of Artificial Sequence: Synthetic heavy chain variable domain
QVQLVESGGGLVKPGGSLRLSCAASGFTFSNAWMSWVRQAPGKGLEWVGRIKSKTDGGTTDYAAPVKGRFTISRDDSKNSLYLQMNSLKTEDTAVYYCARDFGRWSYYFDYWGQGTLVTVSS

SEQ ID NO: 2767 - protein, 122 aa, Artificial Sequence
  Description of Artificial Sequence: Synthetic heavy chain variable domain
QVTLKESGGGLVKPGGSLRLSCAASGFTFSNAWMSWVRQAPGKGLEWVGRIKSKTDGGTTDYAAPVKGRFTISRDDSKNTLYLQMNSLRTEDTAVYYCARDFGRWSYYFDYWSQGTLVTVSS

SEQ ID NO: 2768 - protein, 122 aa, Artificial Sequence
  Description of Artificial Sequence: Synthetic heavy chain variable domain
EVQLVESGGGLVKPGGSLRLSCAASGFTFSNAWMSWVRQAPGKGLEWVGRIKSKTDGGTTDYAAPVKGRFTISRDDSKNTLYLQMNSLRTEDTAVYYCARDFGRWSYYFDYWSQGTLVTVSS

SEQ ID NO: 2769 - protein, 119 aa, Artificial Sequence
  Description of Artificial Sequence: Synthetic heavy chain variable domain
EVQLVESGGGLVQPGRSLRLSCTASGFTFGDYAMSWVRQAPGKGLEWVSSISGSGRSTDHADYVKGRFTISRDNSKNTVYLQMNRLRAEDTAVYYCAKVSNYEYYFDYWAQGTLVTVSS

SEQ ID NO: 2770 - protein, 122 aa, Artificial Sequence
  Description of Artificial Sequence: Synthetic heavy chain variable domain
QVTLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSS

SEQ ID NO: 2771 - protein, 122 aa, Artificial Sequence
  Description of Artificial Sequence: Synthetic heavy chain variable domain
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSS

SEQ ID NO: 2772 - protein, 125 aa, Artificial Sequence
  Description of Artificial Sequence: Synthetic heavy chain variable domain
QVQLVESGGGLVKPGRSLRLSCTASGFTFGDYAMSWFRQAPGKGLEWVGFIRSKAYGGTTEYAASVKGRFTISRDDSKSIAYLQMNSLKTEDTAVYYCAKDFEVREAHLSYFDYWGQGTLVTVSS

SEQ ID NO: 2773 - protein, 125 aa, Artificial Sequence
  Description of Artificial Sequence: Synthetic heavy chain variable domain
EVQLVESGGGLVKPGRSLRLSCTASGFTFGDYAMSWFRQAPGKGLEWVGFIRSKAYGGTTEYAASVKGRFTISRDDSKSIAYLQMNSLKTEDTAVYYCAKDFEVREAHLSYFDYWGQGTLVTVSS

SEQ ID NO: 2774 - protein, 125 aa, Artificial Sequence
  Description of Artificial Sequence: Synthetic heavy chain variable domain
QVTLKESGGGLVKPGGSLRLSCAASGFTFSNAWMSWVRQAPGKELEWVGRIKSKTDGGTTDYAAPVKGRFTISRDDSKKTLYLQMNSLKTEDTAVYYCARGSNERFLEWLNFDYWGQGTLVTVSS

SEQ ID NO: 2775 - protein, 122 aa, Artificial Sequence
  Description of Artificial Sequence: Synthetic heavy chain variable domain
EVQLLESGGGVVQPGGSLRLSCAASGFTFDTFWMSWVRQAPGKGLEWVGRIKSKTDGGTTDYAAPVKGRFTISRDDSKNTLYLQMNSLKTEDTAVYYCARDFGRWSYYFDYWSQGTLVTVSS

SEQ ID NO: 2776 - protein, 125 aa, Artificial Sequence
  Description of Artificial Sequence: Synthetic heavy chain variable domain
QITLKESGGGLVKPGRSLRLSCTASGFTFGDYAMSWFRQAPGKGLEWVGFIRSKAYGGTTEYAASVKGRFTISRDDSKSIAYLQMNSLKTEDTAVYYCAKDFEVRGAHLSYFDYWGQGTLVTVSS

SEQ ID NO: 2777 - protein, 123 aa, Artificial Sequence
  Description of Artificial Sequence: Synthetic heavy chain variable domain
QVQLVESGGGLVQPGGSLRLSCAASGFTFSTSAMSWVRQAPGKGLEWVSTISTDGATTWYADSVRGRFSVSRDNSKNTLYLQMTGLRAEDTAVYYCARVLRSGFLEWNLFDYWGQGTLVTVSS

SEQ ID NO: 2778 - protein, 120 aa, Artificial Sequence
  Description of Artificial Sequence: Synthetic heavy chain variable domain
QVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARVIFGVVNIPDYWGQGTLVTVSS

SEQ ID NO: 2779 - protein, 125 aa, Artificial Sequence
  Description of Artificial Sequence: Synthetic heavy chain variable domain
QVQLVESGGGLVKPGGSLRLSCAASGFTFINAWMSWVRQAPGKGLEWVGRIKSKTDGGTTDYAAPVKGRFTISRDDSKNTLYLQMNSLKTEDTAVYYCARTYSSSWYESLLFDYWGQGTLVTVSS

SEQ ID NO: 2780 - protein, 127 aa, Artificial Sequence
  Description of Artificial Sequence: Synthetic heavy chain variable domain
QVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARQGDSSSWYVEVYYFDYWGQGTLVTVSS

SEQ ID NO: 2781 - protein, 126 aa, Artificial Sequence
  Description of Artificial Sequence: Synthetic heavy chain variable domain
QVQLVESGGGLVKPGGSLRLSCAASGFTFSNAWMSWVRQAPGKGLEWVGRIKSKTDGGTTDYAAPVKGRFTISRDDSKKTLYLQMNSLKTEDTAVYYCARGSGELRFLESYYFDYWGQGTLVTVSS

SEQ ID NO: 2782 - protein, 122 aa, Artificial Sequence
  Description of Artificial Sequence: Synthetic heavy chain variable domain
QVQLVESGGGLVQPGRSLRLSCTASGFTFGDYAMSWVRQAPGKGLEWVGFIRSKAYGGTTEYAASVKGRFTISRDDSQSIAYLQMDSLKTEDTAVYYCAKVGPSWDYYFDYWGQGTLVTVSS

SEQ ID NO: 2783 - protein, 125 aa, Artificial Sequence
  Description of Artificial Sequence: Synthetic heavy chain variable domain
QITLKESGGGLVKPGRSLRLSCTASGFTFGDYAMSWFRQAPGKGLEWVGFIRSKAYGGTTEYAASVKGRFTISRDDSKSIAYLQMNSLKTEDTAVYYCAKDFEVREAHLSYFDYWGQGTLVTVSS

SEQ ID NO: 2784 - protein, 125 aa, Artificial Sequence
  Description of Artificial Sequence: Synthetic heavy chain variable domain
EVQLVESGGGLVKPRGSLRLSCAASGFTFSNAWMSWVRQAPGKGLEWVGRIKSKTDGGTTDYAAPVKGRFTISRDDSKNTLYLQMNSLKTEDTAVYYCARTSRGRFLEWLLFDYWGQGTLVTVSS

SEQ ID NO: 2785 - protein, 123 aa, Artificial Sequence
  Description of Artificial Sequence: Synthetic heavy chain variable domain
EVQLVESGGGLVRPGGSLRLSCAASGLTFSRTWMSWVRQAPGKGLEWVASINDDGSEKYYVDSVKGRFTISRDNARNSLYLQMNRLRAEDTAVYYCARVDSERFLEWYYFDYWGQGTLVTVSS

SEQ ID NO: 2786 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGKINHSGSTNYNPSLKSRVTISVDTSKNQFSLKLSSVTAADTAVYYCARGQIAAHVWGWFDPWGQGTLVTVSS

SEQ ID NO: 2787 - protein, 121 aa, Artificial Sequence
  Description of Artificial Sequence: Synthetic heavy chain variable domain
QITLKESGGGLVQPGGSLRLSCAASGFTFSSYAMSWVRQAPGKGLEWVSAISGSGGSTYYADSVKGRFTISRDNSKNTLYLQMNSLRAEDTAVYYCAKERSRWGDNWFDPWGQGTLVTVSS

SEQ ID NO: 2788 - protein, 118 aa, Artificial Sequence
  Description of Artificial Sequence: Synthetic heavy chain variable domain
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARIYPPDAFDIWGQGTMVTVSS

SEQ ID NO: 2789 - protein, 125 aa, Artificial Sequence
  Description of Artificial Sequence: Synthetic heavy chain variable domain
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDMVGAWLVLSYFDYWGQGTLVTVSS

SEQ ID NO: 2790 - protein, 119 aa, Artificial Sequence
  Description of Artificial Sequence: Synthetic heavy chain variable domain
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARVRGSEYYFDYWGQGTLVTVSS

SEQ ID NO: 2791 - protein, 125 aa, Artificial Sequence
  Description of Artificial Sequence: Synthetic heavy chain variable domain
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKGIGYSSSWYEIWTFDYWGQGTLVTVSS

SEQ ID NO: 2792 - protein, 125 aa, Artificial Sequence
  Description of Artificial Sequence: Synthetic heavy chain variable domain
QITLKESGGGLVQPGGSLRLSCAASGFTFSNAWMSWVRQAPGKGLEWVGRIKSKTDGGTTDYAAPLKGRFTISRDDSKNTLYLQMNSLKTEDTAVYYCARAKGLWFGESYYFDYWGQGTLVTVSS

SEQ ID NO: 2793 - protein, 119 aa, Artificial Sequence
  Description of Artificial Sequence: Synthetic heavy chain variable domain
QVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARVNGGEYYFDYWGQGTLVTVSS

SEQ ID NO: 2794 - protein, 121 aa, Artificial Sequence
  Description of Artificial Sequence: Synthetic heavy chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAEDTAVYYCARGPLRPQKVLPFQIGAQGTLVTVSS

SEQ ID NO: 2795 - protein, 124 aa, Artificial Sequence
  Description of Artificial Sequence: Synthetic heavy chain variable domain
  MOD_RES (64)..(64): Any amino acid
QVQLVESGGGVVQPGRSLRLSCAASGFTFSSYAMHWVRQAPGKGLEWVAVISYDGSTNYNPSLXAASRVTISVDTSKNQFSLKLSSVTAADTAVYYCARVYGYDYRDFGWFDPWGQGTLVTVSS

SEQ ID NO: 2796 - protein, 126 aa, Artificial Sequence
  Description of Artificial Sequence: Synthetic heavy chain variable domain
  MOD_RES (64)..(64): Any amino acid
  MOD_RES (106)..(106): Any amino acid
QVQLVESGGGVVQPGRSLRLSCAASGFTFSSYAMHWVRQAPGKGLEWVAVISYDGSTNYNPSLXAASRVTISVDTSKNQFSLKLSSVTAADTAVYYCARVYGYDYXAADFGWFDPWGQGTLVTVSS

SEQ ID NO: 2797 - protein, 121 aa, Artificial Sequence
  Description of Artificial Sequence: Synthetic heavy chain variable domain
QEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISS

SEQ ID NO: 2798 - protein, 121 aa, Artificial Sequence
  Description of Artificial Sequence: Synthetic heavy chain variable domain
QVQLQQSGAEVKKPGASVKVSCKASGYTFSRYYIHWVRRAPGQGLEWMGLINPGGGSTNYAQKFQGRVTMTRDTSTNTVYLELSSLRSDDTAVYYCARDYGTIDARRFDFWGQGTLVTVSS

SEQ ID NO: 2799 - protein, 120 aa, Artificial Sequence
  Description of Artificial Sequence: Synthetic heavy chain variable domain
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLSSSSYDAFDIWGQGTMVTVSS

SEQ ID NO: 2800 - protein, 120 aa, Artificial Sequence
  Description of Artificial Sequence: Synthetic heavy chain variable domain
EVQLVQSGAELKKPGSSVRVSCKTSGGSFKTHGISWVRQAPGQGLEWMGWINPNSGGALYVDNFQGRATMTRDTSINTAYMELRSLSSDDTAVYYCARGMADLIDVFDIWGQGTMVTVSS

SEQ ID NO: 2801 - protein, 121 aa, Artificial Sequence
  Description of Artificial Sequence: Synthetic heavy chain variable domain
EVQLVQSGGGVVQPGGPLRLSCAASGFTFSSYSMNWVRQAPGKGLEWVSSISSSSSYIYYADSVKGRFTISRDNAKNSLYLQMNSLRAEDTAVYYCARGLGGWTHDAFDIWGQGTMVTVSS

SEQ ID NO: 2802 - protein, 121 aa, Artificial Sequence
  Description of Artificial Sequence: Synthetic heavy chain variable domain
QVQLVQSGGGLVKPGGSLRLSCAASGFTFGTYSMNWVRQAPGKGLEWVSSISSSSSYIYYADSVKGRFTISRDNAKNSLYLQMNSLRAEDTAVYYCARGLGGWTHDAFDIWGQGTTVTVSS

SEQ ID NO: 2803 - protein, 119 aa, Artificial Sequence
  Description of Artificial Sequence: Synthetic heavy chain variable domain
EVQLVESGGGLVKPGGSLRLSCAASGFTFSDYYMGWVRQAPGKGLKWLSYISDRAHTIYDTDSVKGRFTISRDDAKSSLYLRMNNLRVEDTAVYYCARAVGAGEGFDYWGQGTLVTVSS

SEQ ID NO: 2804 - protein, 121 aa, Artificial Sequence
  Description of Artificial Sequence: Synthetic heavy chain variable domain
QMQLVQSGAEVKKPGASVKVSCKASGYTFSRYYIHWVRQAPGQGLEWMGLINPGGGSTNYAQKFQGRVTMTRDTSTNTVYLELSSLRSDDTAVYYCARDYGTIDARRFDFWGQGTLVTVSS

SEQ ID NO: 2805 - protein, 118 aa, Artificial Sequence
  Description of Artificial Sequence: Synthetic heavy chain variable domain
EVQLVQSGPGLVKPSGTLSLTCAVSGGSISSSNWWSWVRQPPGKGLEWIGEIYHSGSTNYNPSLKSRVTISVDKSKNQFSLKLGSVTAADTATYYCARDLWLGEWDLWGQGTLVTVSS

SEQ ID NO: 2806 - protein, 119 aa, Artificial Sequence
  Description of Artificial Sequence: Synthetic heavy chain variable domain
EVQLVESGGGLVKPGGSLKLSCAASGFTFSDYYMGWVRQAPGKGLKWLSYISDRAHTIYDTHSVKGRFTISRDDAKSSLYLRMNNLRVEDTAVYYCARAVGAGEGFDYWCQGTLVTVSS

SEQ ID NO: 2807 - protein, 121 aa, Artificial Sequence
  Description of Artificial Sequence: Synthetic heavy chain variable domain
EVQLVQSGAEVKKPGSSVKVSCKASGGTFSTFAINWVRQAPGQGLEWMGGVIPVSGTEDYSQKFQGRLSLTADESTGTAYMELSSLRSDDTAVYYCARDRSGRDWDYFDYWGQGTLVTVSS

SEQ ID NO: 2808 - protein, 118 aa, Artificial Sequence
  Description of Artificial Sequence: Synthetic heavy chain variable domain
EVQLVQSGAEVRKPGSSVKVSCKASGGSLSSHGVSWVRQAPGQGLEWMARIIPMFGLTDYAQNFQARVTISADRSTNTVYMEISNLGSEDTAVYFCARESLGATFEYWGQGTLVTVSS

SEQ ID NO: 2809 - protein, 118 aa, Artificial Sequence
  Description of Artificial Sequence: Synthetic heavy chain variable domain
QVQLVQSGTEVKKPGSSVKVSCQASGGSLSSHGVSWLRQAPGQGLEWVGRIIPMFGVTDYAQKFQDRVTITADKSTSTVYMELISLGSDDTAVYFCARESRGATFEYWGQGTLVTVSS

SEQ ID NO: 2810 - protein, 125 aa, Artificial Sequence
  Description of Artificial Sequence: Synthetic heavy chain variable domain
QVQLQQSGAEVKKPGASVKVSCKASGYTSTNYGISWVRQAPGQGLEWMGWISTYNGNTNYAQKLQGRVTMTTDTSTSTAYMELRSLRSDDTAVYYCARDYYSDSSGYWDDAFDIWGQGTMVTVSS

SEQ ID NO: 2811 - protein, 125 aa, Artificial Sequence
  Description of Artificial Sequence: Synthetic heavy chain variable domain
QVQLQQSGAEVKKPGASVRVSCKASGYSFGNNGITWVRQAPGQGLEWMGWISTYNGNTNYAQKLQGRVTMTTDTSTSTAYMELRSLRSDDTAVYYCARDYYSDSSGYWDDAFDIWGQGTTVTVSS

SEQ ID NO: 2812 - protein, 122 aa, Artificial Sequence
  Description of Artificial Sequence: Synthetic heavy chain variable domain
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDGDMVYDSSGPDYWGQGTLVTVSS

SEQ ID NO: 2813 - protein, 119 aa, Artificial Sequence
  Description of Artificial Sequence: Synthetic heavy chain variable domain
QLQLQESGPGLVKPSETLSLTCTVSGGSISSSSYYWGWIRQPPGKGLEWIGSIYYSGSTYYNPSLKSRVTISVDTSKNQFSLKLGSVTAADTAVYYCARHDGTDAFDIWGQGTTVTVSS

SEQ ID NO: 2814 - protein, 125 aa, Artificial Sequence
  Description of Artificial Sequence: Synthetic heavy chain variable domain
EVQLVQSGAEVKKPGASVKVSCKASGYTFNNYGFSWVRQAPGQGLEWMGWISVYNGNTNYAQKLQGRVTMTTDTSTSTAYMELRSLRSDDTAVYYCARDYYSDSSGYWDDAFDIWGQGTMVTVSS

SEQ ID NO: 2815 - protein, 125 aa, Artificial Sequence
  Description of Artificial Sequence: Synthetic heavy chain variable domain
EVQLVQSGAEVKKPGSSVKISCKASGGAFTNFGISWVRQAPGQGLEWMGWISTYNSETNYAQKLQGRVTMTTDTSTSTAYMELRSLRSDDTAVYYCARDYYSDSSGYWDDAFDIWGQGTLVTVSS

SEQ ID NO: 2816 - protein, 119 aa, Artificial Sequence
  Description of Artificial Sequence: Synthetic heavy chain variable domain
QVQLQQSGPGLVKPSQTLSLTCAISGDSVSSNSATWNWIRQSPSRGLEWLGRTYYRSKWYNDYAVSVKSRIIINPDTSKNQFSLQLNSVTPEDTAVYYCARGVRAFDIWGQGTTVTVSS

SEQ ID NO: 2817 - protein, 120 aa, Artificial Sequence
  Description of Artificial Sequence: Synthetic heavy chain variable domain
QVQLVQSGAEVKEPGASVKVSCKASGYTFRNSGITWVRQAPGQGLEWMGWINPNSGGAMYVDNFQGRATMTRDTSINTAYMELRSLSSDDTAVYYCARGMADLIDVFDIWGQGTLVTVSS

SEQ ID NO: 2818 - protein, 118 aa, Artificial Sequence
  Description of Artificial Sequence: Synthetic heavy chain variable domain
EVQLVESGGGVVRPGGSLRLSCATSGFNFDNYGLSWVRQGPGKGLEWMGFIYKSVNTNYSPSLKSRLTISMDTSKNQFSLNLASVTTADTAIYYCARGKVETSVVDYWGQGTLVTVSS

SEQ ID NO: 2819 - protein, 119 aa, Artificial Sequence
  Description of Artificial Sequence: Synthetic heavy chain variable domain
QVTLKESGPTLLKPTQTLTLTCTFSGFSLSTRGVGVGWIRQPPGQALEWLTLIYWDDDKRYSPSLKSRLTITKDTSKNQVVLTMTNMESVDTATYYCAQQTMTGAFDIWGQGTTVTVSS

SEQ ID NO: 2820 - protein, 121 aa, Artificial Sequence
  Description of Artificial Sequence: Synthetic heavy chain variable domain
QVQLQESGPGLVKSSETLSLTCTVSGGSMNNYYWSWIRQPAGKGLEWMGRIYSSGSTNYNPALKSRVTMSVDTSKNQFSLNLSSVTAADTAIYYCARASWSGTYWALFDYWGQGTLVTVSS

SEQ ID NO: 2821 - protein, 125 aa, Artificial Sequence
  Description of Artificial Sequence: Synthetic heavy chain variable domain
EVQLVQSGNEVKRPGASVKVSCKASGHSFSTYGFSWVRQAPGQGLEWMGWISTYNGNTNYAQKLQGRVTMTTDTSTSTAYMELRSLRSDDTAVYYCARDYYSDSSGYWDDAFDIWGQGTLVTVSS

SEQ ID NO: 2822 - protein, 119 aa, Artificial Sequence
  Description of Artificial Sequence: Synthetic heavy chain variable domain
QLQLQESGPGLVKPSETLSLTCTVSGGSISSNSYYWGWIRQPPGKGLEWIGSIYYSGSTYYNPSLKSRVTISVDTSKNQFSLKLGSVTAADTAVYYCARHDGTDAFDIWGQGTTVTVSS

SEQ ID NO: 2823 - protein, 121 aa, Artificial Sequence
  Description of Artificial Sequence: Synthetic heavy chain variable domain
QMQLVQSGGDLVQPGGSLRLSCAASGFTFSSYSMNWVRQAPGKGLEWVSSISSSSSYIYYADSVKGRFTISRDNAKNSLYLQMNSLRAEDTAVYYCARGLGGWTHDAFDIWGQGTTVTVSS

SEQ ID NO: 2824 - protein, 121 aa, Artificial Sequence
  Description of Artificial Sequence: Synthetic heavy chain variable domain
QVQLVQSGGDLVQPGGSLRLSCAASGFTFSSYSMNWVRQAPGKGLEWVSSISSSSSYIYYADSVKGRFTISRDNAKNSLYLQMNSLRAEDTAVYYCARGLGGWTHDAFDIWGQGTTVTVSS

SEQ ID NO: 2825 - protein, 119 aa, Artificial Sequence
  Description of Artificial Sequence: Synthetic heavy chain variable domain
EVQLVQSGAEVKKPGESLKISCKGSGYSFSRYWIGWVRQMPGKGLEWMGIIYPRDSDTRYSPSFQGQVTISADKSISTAYLQWSSLKASDTAMYYCATPVVTAGAFDIWGQGTMVTVSS

SEQ ID NO: 2826 - protein, 121 aa, Artificial Sequence
  Description of Artificial Sequence: Synthetic heavy chain variable domain
EVQLVQSGGDLVQPGGSLRLSCAASGFTFSSYSMNWVRQAPGKGLEWVSSISSSSSYIYYADSVKGRFTISRDNAKNSLYLQMNSLRAEDTAVYYCARGLGGWTHDAFDIWGQGTTVTVSS

SEQ ID NO: 2827 - protein, 116 aa, Artificial Sequence
  Description of Artificial Sequence: Synthetic heavy chain variable domain
EVQLVETGGGLVKPGGSLRLSCEASGFSLSSYSMNWVRQAPGKGLEWVSSISSSSTHIYYADSLKGRFTISRDNAKNSLFLQMDNLRAEDTAVYYCARATIGFDYWGQGTLVTVSS

SEQ ID NO: 2828 - protein, 121 aa, Artificial Sequence
  Description of Artificial Sequence: Synthetic heavy chain variable domain
EVQLVQSGAEVKKPGASVKVSCKASGYTFTDYYIHWVRQAPGQGLEWMGWMNPNSGNSVSAQKFQGRVTMTRDTSINTAYMELSSLTSDDTAVYYCARNSEWHPWGYYDYWGQGTLVTVSS

SEQ ID NO: 2829 - protein, 121 aa, Artificial Sequence
  Description of Artificial Sequence: Synthetic heavy chain variable domain
QVQLVQSGAEVKKPGASVKVSCKASGYTFSRYYIHWVRQAPGQGLEWMGLINPGGGSTNYAQKFQGRVTMTRDTSTNTVYLELSSLRSDDTAVYYCARDYGTIDARRFDFWGQGTLVTVSS

SEQ ID NO: 2830 - protein, 121 aa, Artificial Sequence
  Description of Artificial Sequence: Synthetic heavy chain variable domain
QVQLQQSGAEVKKPGASVKVSCKASGYTFSRYYIHWVRQAPGQGLEWMGIINTDGGTTTYAQKFQGRLTMTRDTSTSTVYMELSSLRSDDTAVYYCARDYGTIDARRFDYWGQGTLVTVSS

SEQ ID NO: 2831 - protein, 125 aa, Artificial Sequence
  Description of Artificial Sequence: Synthetic heavy chain variable domain
QVQLQQSGAEVKKPGASVKVSCKASGHTFSNYGISWVRQAPGQGLEWMGWISTYNGNTNYAQKLQGRVTMTTDTSTSTAYMELRSLRSDDTAVYYCARDYYSDSSGYWDDAFDIWGQGTTVTVSS

SEQ ID NO: 2832 - protein, 119 aa, Artificial Sequence
  Description of Artificial Sequence: Synthetic heavy chain variable domain
EAQLVESGGGLVKPGGSLRLSCAASGFTFSDYYMGWVRQAPGKGLKWLSYISDRAHTIYDTDSVKGRFTISRDDAKSSLYLRMNNLRVEDTAVYYCARAVGAGEGFDYWGQGTLVTVSS

SEQ ID NO: 2833 - protein, 125 aa, Artificial Sequence
  Description of Artificial Sequence: Synthetic heavy chain variable domain
QVTLKESGPTLVKPTQTLTLTCTFSGFSLSSFGVAVGWFRQPPGKALEWLGLIYWDDDKRYSPSLKTRLTITKDTSKNQVVLTMTNMDPVDTATYYCAHKGGIATTGSPNWFDPWGQGTLVTVSS

SEQ ID NO: 2834 - protein, 126 aa, Artificial Sequence
  Description of Artificial Sequence: Synthetic heavy chain variable domain
QVTLKESGPTLVKPTQTLTLTCTFSGFSLNSFGVAVGWFRQPPGKALEWLGLIYWDDDRRYFPSLEGRLSITKDASDNNVVLTMMNVDPADTATYYCARTSPMVQGIANYYAMDVWGQGTTVTVSS

SEQ ID NO: 2835 - protein, 124 aa, Artificial Sequence
  Description of Artificial Sequence: Synthetic heavy chain variable domain
QLQLQESGPGVVKPSGTLSLTCTVSGGSISRSDGYWGWVRQPPGKGLEWIGSIYDTGTTYYSPSLKSRLIISVDTSKNQFSLTLNSVTAADTAVYYCASMGGLRSSSSDAFHTWGPGTMVTVSS

SEQ ID NO: 2836 - protein, 119 aa, Artificial Sequence
  Description of Artificial Sequence: Synthetic heavy chain variable domain
EVQLVESGGGLVKPGGSLRLSCAASGFTFSDYYMSWIRQAPGKGLEWVSYISDSTNTIYYADSVKGRFTVSRDNPKNSLYLQMISLRAEDTAVYYCARAVGAGEGFDHWGQGTLVTVSS

SEQ ID NO: 2837 - protein, 120 aa, Artificial Sequence
  Description of Artificial Sequence: Synthetic heavy chain variable domain
QVQLVQSGAEVKKPGESLKISCKDSGYSFTNYWLGWVRQMPGKGLEWMGIIYPGDSDTRYSPSFRGQVTISADKSISTAYLQWSSLKASDTAMYYCARLNLATHTAFDIWGQGTTVTVSS

SEQ ID NO: 2838 - protein, 120 aa, Artificial Sequence
  Description of Artificial Sequence: Synthetic heavy chain variable domain
QMQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGGYTGWSPSDPWGQGTLVTVSS

SEQ ID NO: 2839 - protein, 118 aa, Artificial Sequence
  Description of Artificial Sequence: Synthetic heavy chain variable domain
QVQLQQSGPELVKPGASVKISCKASGYSFSDYYMHWVKQSPENSLEWIGQINPTTGGASYNQKFKGKATLTVDKSSSTAYMQLKSLTSEESAVYYCTRYYYGRHFDVWGQGTTVTVSS

SEQ ID NO: 2840 - protein, 118 aa, Artificial Sequence
  Description of Artificial Sequence: Synthetic heavy chain variable domain
QVQLQQSGAELAKPGASVKMSCKASGYTFTRYWMHWVKQRPGQGLEWIGYINPSTGYSDYNQKFKDKATLTADKSSSTAYMQLSSLTSEDSAVYYCARDPYGWTMDSWGQGTLVTVSS

SEQ ID NO: 2841 - protein, 118 aa, Artificial Sequence
  Description of Artificial Sequence: Synthetic heavy chain variable domain
QVQLVQSGAEVKKPGSSVKVSCKASGYSFSDYYMHWVRQAPGQGLEWMGQINPTTGGASYNQKFKGKATITVDKSTSTAYMELSSLRSEDTAVYYCARYYYGRHFDVWGQGTTVTVSS

SEQ ID NO: 2842 - protein, 215 aa, Artificial Sequence
  Description of Artificial Sequence: Synthetic heavy chain variable domain
EVQLVESGGGLVQPGGSLRLSCAASGYTFTDHAIHWVRQSPGKGLEWVAYFSPGNDDFKYADSVKGRFTISADTSKNTAYLQMNSLRAEDTAIYYCSRSLNMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 2843 - protein, 120 aa, Artificial Sequence
  Description of Artificial Sequence: Synthetic heavy chain variable domain
QVQLVQSGAEVKKPGASVKVSCKASGYKFTSYVMHWVRQAPGQGLEWIGYINPYNDVTKYNEKFKGRVTITADKSTSTAYLQMNSLRSEDTAVHYCARGSYYDYDGFVYWGQGTLVTVSS

SEQ ID NO: 2844 - protein, 117 aa, Artificial Sequence
  Description of Artificial Sequence: Synthetic heavy chain variable domain
QVQLVQSGAEVKKPGTSVKVSCKVPGYTFSSYAISWVRQAPGQGLEWMGGIIPIFGTTNYAQKFQGRVTITGEESTSTVYMELSSLRSEDTAVYYCARDTDYMFDYWGQGTLVTVSS

SEQ ID NO: 2845 - protein, 117 aa, Artificial Sequence
  Description of Artificial Sequence: Synthetic heavy chain variable domain
QVQLVQSGAEVKKPGASVKVSCKVSGYTFSSYAISWVRQAPGQGLEWMGGIIPIFGTANYAQKFQGRVTITADESTSTAYMELSSLRSEDTAVYYCARDTDYMFDYWGQGTLVTVSS

SEQ ID NO: 2846 - protein, 121 aa, Artificial Sequence
  Description of Artificial Sequence: Synthetic heavy chain variable domain
EVQLVESGGGVVQPGRSVRLSCAASGFTFSTYTMHWVRQAPGKGLEWVAIISNDGSNKYYADPVRGRFTISRDNSKNTLYLQMNSLRAEDTAVYYCVRGSSWYRGNWFDPWGQGTLVTVSS

SEQ ID NO: 2847 - protein, 121 aa, Artificial Sequence
  Description of Artificial Sequence: Synthetic heavy chain variable domain
EVQLVETGAEVKKPGASVKVSCKASGYTFTGYYMHWVRQAPGQGLEWMGWINPTSGSTNYAQKFQGRVTMTRDTSISTAYMELSGLRSDDTAVYYCVRDPGSPKWLAFDPWGQGTLVTVSS

SEQ ID NO: 2848 - protein, 214 aa, Artificial Sequence
  Description of Artificial Sequence: Synthetic heavy chain variable domain
DIQMTQSPSSLSASVGDRVTITCRASQGIGHYLAWYQQKPGKVPKLLIYTASTLQSGVPSRFSGSGSGTDFTLTISSLQPEDVATYYCQQFNSYPHTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2849 - protein, 127 aa, Artificial Sequence
  Description of Artificial Sequence: Synthetic heavy chain variable domain
EVQLQESGPGLVKPSETLSLTCTVSGGSISSDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS

SEQ ID NO: 2850 - protein, 127 aa, Artificial Sequence
  Description of Artificial Sequence: Synthetic heavy chain variable domain
EVQLQESGPGLVKPSETLSLTCTVSGGSISSDYWGWIRQPPGKGLEWIGFITYSGSTSYNPSLKSRITISRDTSKNQFSLKLSSVTAADTAVYYCARMPSFITLASLSTWEGYFDFWGQGTMVTVSS

SEQ ID NO: 2851 - protein, 127 aa, Artificial Sequence
  Description of Artificial Sequence: Synthetic heavy chain variable domain
EVQLQESGPGLVKPSETLSLTCTVSGSSISSDYWGWIRQPPGKGLEWMGFITYSGSTSYNPSLKSRITISRDTSKNQFSLKLSSVTAADTAVYYCARMPSFITLASLSTWEGYFDFWGQGTMVTVSS

SEQ ID NO: 2852 - protein, 119 aa, Artificial Sequence
  Description of Artificial Sequence: Synthetic heavy chain variable domain
EVQLVQSGAEVKKPGASVKVSCKASGYTFSSYVMHWVRQAPGQRLEWIGYIDPYNDGAKYSQKFQGRVTLTRDTSASTAYMELSSLRSEDTAVYYCARGGPYGWYFDVWGQGTTVTVSS

SEQ ID NO: 2853 - protein, 119 aa, Artificial Sequence
  Description of Artificial Sequence: Synthetic heavy chain variable domain
EVQLVQSGAEVKKPGASVKVSCKASGYTFSSYVMHWVRQAPGQRLEWIGYIDPYNDGAKYSQKFQGRVTLTSDKSASTAYMELSSLRSEDTAVYYCARGGPYGWYFDVWGQGTTVTVSS

SEQ ID NO: 2854 - protein, 119 aa, Artificial Sequence
  Description of Artificial Sequence: Synthetic heavy chain variable domain
EVQLVQSGAEVKKPGASVKVSCKASGYTFSSYVMHWVRQAPGQGLEWIGYIDPYNDGAKYAQKFQGRVTLTRDTSTSTVYMELSSLRSEDTAVYYCARGGPYGWYFDVWGQGTTVTVSS

SEQ ID NO: 2855 - protein, 119 aa, Artificial Sequence
  Description of Artificial Sequence: Synthetic heavy chain variable domain
EVQLVQSGAEVKKPGASVKVSCKASGYTFSSYVMHWVRQAPGQGLEWIGYIDPYNDGAKYAQKFQGRVTLTSDKSTSTVYMELSSLRSEDTAVYYCARGGPYGWYFDVWGQGTTVTVSS

SEQ ID NO: 2856 - protein, 119 aa, Artificial Sequence
  Description of Artificial Sequence: Synthetic heavy chain variable domain
EVQLVQSGAEVKKPGSSVKVSCKASGYTFSSYVMHWVRQAPGQGLEWIGYIDPYNDGAKYAQKFQGRVTLTSDKSTSTAYMELSSLRSEDTAVYYCARGGPYGWYFDVWGQGTTVTVSS

SEQ ID NO: 2857 - protein, 119 aa, Artificial Sequence
  Description of Artificial Sequence: Synthetic heavy chain variable domain
EVQLVQSGAEVKKPGASVKVSCKASGYTFSSYVMHWVRQAPGQGLEWIGYIDPYNDGAKYAQKFQGRVTLTSDKSISTAYMELSRLRSDDTVVYYCARGGPYGWYFDVWGQGTTVTVSS

SEQ ID NO: 2858 - protein, 127 aa, Artificial Sequence
  Description of Artificial Sequence: Synthetic heavy chain variable domain
EVQLQESGPGLVKPSETLSLTCTVSGGSISSDYWGWIRQPPGKGLEWIGFITYSGSTSYNPSLKSRVTISRDTSKNQFSLKLHSVTAADTAVYYCARMPSFITLASLSTWEGYFDFWGQGTMVTVSS

SEQ ID NO: 2859 - protein, 116 aa, Artificial Sequence
  Description of Artificial Sequence: Synthetic heavy chain variable domain
QVQLMESGPGLVQPSQTLSLTCTVSGFPLTSYTVHWVRQPPGKGLEWIGAIWSSGSTDYNSALKSRLNINRDSSKSQVFLKMNSLQTEDTAIYFCTKSGWAFFDYWGQGVMVTVSS

SEQ ID NO: 2860 - protein, 119 aa, Artificial Sequence
  Description of Artificial Sequence: Synthetic heavy chain variable domain
EVQLVESGGDLVQPGRSLKISCVASGFTFSDYYMAWVRLAPQKGLEWVASISYEGSRTHYGDSVRGRFIISRDNPKNILYLQMNSLGSEDTATYFCARHTGTLDWLVYWGQGTLVIVSS

SEQ ID NO: 2861 - protein, 127 aa, Artificial Sequence
  Description of Artificial Sequence: Synthetic heavy chain variable domain
EVQLQESGPGLVKPSETLSLTCTVSGGSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS

SEQ ID NO: 2862 - protein, 127 aa, Artificial Sequence
  Description of Artificial Sequence: Synthetic heavy chain variable domain
  MOD_RES (6)..(6): Any amino acid
  MOD_RES (9)..(9): Any amino acid
  MOD_RES (12)..(12): Any amino acid
  MOD_RES (15)..(17): Any amino acid
  MOD_RES (23)..(23): Any amino acid
  MOD_RES (25)..(25): Any amino acid
  MOD_RES (27)..(27): Any amino acid
  MOD_RES (30)..(30): Any amino acid
  MOD_RES (37)..(37): Any amino acid
  MOD_RES (39)..(40): Any amino acid
  MOD_RES (43)..(45): Any amino acid
  MOD_RES (48)..(48): Any amino acid
  MOD_RES (67)..(68): Any amino acid
  MOD_RES (70)..(71): Any amino acid
  MOD_RES (79)..(79): Any amino acid
  MOD_RES (81)..(81): Any amino acid
  MOD_RES (83)..(83): Any amino acid
  MOD_RES (87)..(88): Any amino acid
  MOD_RES (92)..(92): Any amino acid
  MOD_RES (94)..(94): Any amino acid
  MOD_RES (110)..(110): Any amino acid
  MOD_RES (119)..(119): Any amino acid
  MOD_RES (122)..(123): Any amino acid
EVQLQXSGXGLXKPXXXLSLTCXVXGXSIXSDYWGWXRXXPGXXXEWXGFITYSGSTSYNPSLKSRXXIXXDTSKNQFXLXLXSVTXXDTAXYXCARMPSFITLASLSTXEGYFDFWGXGTXXTVSS

SEQ ID NO: 2863 - protein, 127 aa, Artificial Sequence
  Description of Artificial Sequence: Synthetic heavy chain variable domain
  MOD_RES (6)..(6): Any amino acid
  MOD_RES (9)..(9): Any amino acid
  MOD_RES (12)..(12): Any amino acid
  MOD_RES (15)..(16): Any amino acid
  MOD_RES (23)..(23): Any amino acid
  MOD_RES (25)..(25): Any amino acid
  MOD_RES (27)..(27): Any amino acid
  MOD_RES (30)..(30): Any amino acid
  MOD_RES (37)..(37): Any amino acid
  MOD_RES (39)..(40): Any amino acid
  MOD_RES (44)..(45): Any amino acid
  MOD_RES (48)..(48): Any amino acid
  MOD_RES (67)..(67): Any amino acid
  MOD_RES (71)..(71): Any amino acid
  MOD_RES (83)..(83): Any amino acid
  MOD_RES (88)..(88): Any amino acid
  MOD_RES (110)..(110): Any amino acid
  MOD_RES (122)..(123): Any amino acid
EVQLQXSGXGLXKPXXTLSLTCXVXGXSIXSDYWGWXRXXPGKXXEWXGFITYSGSTSYNPSLKSRXTISXDTSKNQFSLKLXSVTAXDTAVYYCARMPSFITLASLSTXEGYFDFWGQGTXXTVSS

SEQ ID NO: 2864 - protein, 119 aa, Artificial Sequence
  Description of Artificial Sequence: Synthetic heavy chain variable domain
  MOD_RES (5)..(5): Any amino acid
  MOD_RES (9)..(9): Any amino acid
  MOD_RES (11)..(12): Any amino acid
  MOD_RES (16)..(16): Any amino acid
  MOD_RES (20)..(20): Any amino acid
  MOD_RES (38)..(38): Any amino acid
  MOD_RES (40)..(40): Any amino acid
  MOD_RES (44)..(44): Any amino acid
  MOD_RES (56)..(57): Any amino acid
  MOD_RES (61)..(62): Any amino acid
  MOD_RES (65)..(65): Any amino acid
  MOD_RES (67)..(68): Any amino acid
  MOD_RES (72)..(72): Any amino acid
  MOD_RES (74)..(74): Any amino acid
  MOD_RES (76)..(76): Any amino acid
  MOD_RES (79)..(79): Any amino acid
  MOD_RES (85)..(85): Any amino acid
  MOD_RES (87)..(87): Any amino acid
  MOD_RES (89)..(89): Any amino acid
  MOD_RES (91)..(92): Any amino acid
  MOD_RES (104)..(104): Any amino acid
  MOD_RES (111)..(111): Any amino acid
EVQLXQSGXEXXKPGXSVKXSCKASGYTFSSYVMHWVXQXPGQXLEWIGYIDPYNXXAKYXXKFXGXXTLTXDXSXSTXYMELSXLXSXDXXVYYCARGGPYGXYFDVWGXGTTVTVSS

SEQ ID NO: 2865 - protein, 127 aa, Artificial Sequence
  Description of Artificial Sequence: Synthetic heavy chain variable domain
EVQLQESGPGLVKPSETLSLTCTVSGSSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS

SEQ ID NO: 2866 - protein, 119 aa, Artificial Sequence
  Description of Artificial Sequence: Synthetic heavy chain variable domain
  MOD_RES (16)..(16): Any amino acid
  MOD_RES (44)..(44): Any amino acid
  MOD_RES (56)..(57): Any amino acid
  MOD_RES (61)..(62): Any amino acid
  MOD_RES (65)..(65): Any amino acid
  MOD_RES (72)..(72): Any amino acid
  MOD_RES (74)..(74): Any amino acid
  MOD_RES (76)..(76): Any amino acid
  MOD_RES (79)..(79): Any amino acid
  MOD_RES (85)..(85): Any amino acid
  MOD_RES (89)..(89): Any amino acid
  MOD_RES (92)..(92): Any amino acid
  MOD_RES (104)..(104): Any amino acid
EVQLVQSGAEVKKPGXSVKVSCKASGYTFSSYVMHWVRQAPGQXLEWIGYIDPYNXXAKYXXKFXGRVTLTXDXSXSTXYMELSXLRSXDTXVYYCARGGPYGXYFDVWGQGTTVTVSS

SEQ ID NO: 2867 - protein, 127 aa, Artificial Sequence
  Description of Artificial Sequence: Synthetic heavy chain variable domain
EVQLQESGPGLVKPSETLSLTCTVSGSSISSDYWGWIRQPPGKGLEWMGFITYSGSTSYNPSLKSRITISVDTSKNQFSLKLHSVTAADTAVYYCARMPSFITLASLSTWEGYFDFWGQGTMVTVSS

SEQ ID NO: 2868 - protein, 127 aa, Artificial Sequence
  Description of Artificial Sequence: Synthetic heavy chain variable domain
EVQLQESGPGLVKPSETLSLTCAVSGYSISSDYWGWIRQPPGKGLEWIGFITYSGSTSYNPSLKSRVTISVDTSKNQFSLKLSSVTAADTAVYYCARMPSFITLASLSTWEGYFDFWGQGTMVTVSS

SEQ ID NO: 2869 - protein, 127 aa, Artificial Sequence
  Description of Artificial Sequence: Synthetic heavy chain variable domain
EVQLQESGPGLVKPSETLSLTCAVSGYSISSDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS

SEQ ID NO: 2870 - protein, 127 aa, Artificial Sequence
  Description of Artificial Sequence: Synthetic heavy chain variable domain
EVQLQESGPGLVKPSETLSLTCAVSGYSISSDYWGWIRQPPGKGLEWIGFITYSGSTSYNPSLKSRITISRDTSKNQFSLKLSSVTAADTAVYYCARMPSFITLASLSTWEGYFDFWGQGTMVTVSS

SEQ ID NO: 2871 - protein, 127 aa, Artificial Sequence
  Description of Artificial Sequence: Synthetic heavy chain variable domain
EVQLQESGPGLVKPSETLSLTCAVSGSSISSDYWGWIRQPPGKGLEWMGFITYSGSTSYNPSLKSRITISRDTSKNQFSLKLSSVTAADTAVYYCARMPSFITLASLSTWEGYFDFWGQGTMVTVSS

SEQ ID NO: 2872 - protein, 127 aa, Artificial Sequence
  Description of Artificial Sequence: Synthetic heavy chain variable domain
EVQLQESGPGLVKPSETLSLTCAVSGYSISSDYWGWIRQPPGKGLEWIGFITYSGSTSYNPSLKSRVTISRDTSKNQFSLKLHSVTAADTAVYYCARMPSFITLASLSTWEGYFDFWGQGTMVTVSS

SEQ ID NO: 2873 - protein, 127 aa, Artificial Sequence
  Description of Artificial Sequence: Synthetic heavy chain variable domain
EVQLQESGPGLVKPSETLSLTCAVSGYSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS

SEQ ID NO: 2874 - protein, 127 aa, Artificial Sequence
  Description of Artificial Sequence: Synthetic heavy chain variable domain
EVQLQESGPGLVKPSETLSLTCAVSGSSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS

SEQ ID NO: 2875 - protein, 127 aa, Artificial Sequence
  Description of Artificial Sequence: Synthetic heavy chain variable domain
EVQLQESGPGLVKPSETLSLTCAVSGSSISSDYWGWIRQPPGKGLEWMGFITYSGSTSYNPSLKSRITISRDTSKNQFSLKLHSVTAADTAVYYCARMPSFITLASLSTWEGYFDFWGQGTMVTVSS

SEQ ID NO: 2876 - protein, 129 aa, Artificial Sequence
  Description of Artificial Sequence: Synthetic heavy chain variable domain
EVQLQESGPGLVKPSETLSLTCTVSGSSIASDYWGWIRQPPGKGLEWIGFITYSGSTSYNPSLKSRVTISVDTSKNQFSLKLSSVTAADTAVYYCARMPSFITLASLSTWEGYFDFWGQGTMVTVSSAS

SEQ ID NO: 2877 - protein, 127 aa, Artificial Sequence
  Description of Artificial Sequence: Synthetic heavy chain variable domain
EVQLQESGPGLVKPSETLSLTCTVSGSSIASDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS

SEQ ID NO: 2878 - protein, 127 aa, Artificial Sequence
  Description of Artificial Sequence: Synthetic heavy chain variable domain
EVQLQESGPGLVKPSETLSLTCTVSGSSIASDYWGWIRKPPGKGLEWIGFITYSGSTSYNPSLKSRVTISRDTSKNQFSLKLSSVTAADTAVYYCARMPSFITLASLSTWEGYFDFWGQGTMVTVSS

SEQ ID NO: 2879 - protein, 127 aa, Artificial Sequence
  Description of Artificial Sequence: Synthetic heavy chain variable domain
EVQLQESGPGLVKPSETLSLTCTVSGSSIASDYWGWIRQPPGKKLEWIGFITYSGSTSYNPSLKSRVTISRDTSKNQFSLKLSSVTAADTAVYYCARMPSFITLASLSTWEGYFDFWGQGTMVTVSS

SEQ ID NO: 2880 - protein, 127 aa, Artificial Sequence
  Description of Artificial Sequence: Synthetic heavy chain variable domain
EVQLQESGPGLVKPSETLSLTCTVSGSSIASDYWGWIRQPPGKGMEWIGFITYSGSTSYNPSLKSRVTISRDTSKNQFSLKLSSVTAADTAVYYCARMPSFITLASLSTWEGYFDFWGQGTMVTVSS

SEQ ID NO: 2881 - protein, 127 aa, Artificial Sequence
  Description of Artificial Sequence: Synthetic heavy chain variable domain
EVQLQESGPGLVKPSETLSLTCTVSGSSIASDYWGWIRKPPGKKMEWIGFITYSGSTSYNPSLKSRVTISRDTSKNQFSLKLSSVTAADTAVYYCARMPSFITLASLSTWEGYFDFWGQGTMVTVSS

SEQ ID NO: 2882 - protein, 127 aa, Artificial Sequence
  Description of Artificial Sequence: Synthetic heavy chain variable domain
EVQLQESGPGLVKPSETLSLTCTVSGSSIASDYWGWIRQFPGKGLEWIGFITYSGSTSYNPSLKSRVTISRDTSKNQFSLKLSSVTADDTAVYYCARMPSFITLASLSTWEGYFDFWGQGTMVTVSS

SEQ ID NO: 2883 - protein, 127 aa, Artificial Sequence
  Description of Artificial Sequence: Synthetic heavy chain variable domain
EVQLQESGPGLVKPSETLSLTCTVSGSSIASDYWGWIRKPPGKKMEWIGFITYSGSTSYNPSLKSRVTISVDTSKNQFSLKLSSVTAADTAVYYCARMPSFITLASLSTWEGYFDFWGQGTMVTVSS

SEQ ID NO: 2884 - protein, 127 aa, Artificial Sequence
  Description of Artificial Sequence: Synthetic heavy chain variable domain
EVQLQESGPGLVKPSETLSLTCSVTGSSIASDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS

SEQ ID NO: 2885 - protein, 127 aa, Artificial Sequence
  Description of Artificial Sequence: Synthetic heavy chain variable domain
EVQLQQSGAGLLKPSETLSLTCSVTGSSIASDYWGWIRQPPGKGLEWIGFITYSGSTSYNPSLKSRVTISVDTSKNQFSLKLSSVTAADTAVYYCARMPSFITLASLSTWEGYFDFWGQGTMVTVSS

SEQ ID NO: 2886 - protein, 127 aa, Artificial Sequence
  Description of Artificial Sequence: Synthetic heavy chain variable domain
EVQLQESGPGLVKPPGTLSLTCSVTGSSIASDYWGWVRQPPGKGLEWIGFITYSGSTSYNPSLKSRVTISVDTSKNQFSLKLSSVTAADTAVYYCARMPSFITLASLSTWEGYFDFWGQGTMVTVSS

SEQ ID NO: 2887 - protein, 121 aa, Artificial Sequence
  Description of Artificial Sequence: Synthetic heavy chain variable domain
DVQLQESGPGLVKPSQSLSLTCTVTGYSITSDYAWNWIRQFPGNKLEWMGYISNSGSASYNPSLKSRISITRDTSKNQFFLQLNSVTTEDTATYYCATLIYYDYGGAMNFWGQGTSVTVSS

SEQ ID NO: 2888 - protein, 119 aa, Artificial Sequence
  Description of Artificial Sequence: Synthetic heavy chain variable domain
EVQLQQSGPELVKPGSSVKMSCKASGYTFSSYVMHWVKQKPGQGLEWIGYIDPYNDGAKYNEKFKGKATLTSDKSSSTAYMELSSLTSEDSAVYYCARGGPYGWYFDVWGAGTTVTVSS

SEQ ID NO: 2889 - protein, 127 aa, Artificial Sequence
  Description of Artificial Sequence: Synthetic heavy chain variable domain
EVQLQESGPGLVKPSQSLSLTCSVTGSSIASDYWGWIRKFPGNKMEWMGFITYSGSTSYNPSLKSRISITRDTSKNQFFLQLHSVTTDDTATYSCARMPSFITLASLSTWEGYFDFWGPGTMVTVSS

SEQ ID NO: 2890 - protein, 127 aa, Artificial Sequence
  Description of Artificial Sequence: Synthetic heavy chain variable domain
EVQLQESGPGLVKPSETLSLTCTVSGGSISSDYWGWIRQPPGKGLEWIGFITYSGSTSYNPSLKSRVTISVDTSKNQFSLKLSSVTAADTAVYYCARMPSFITLASLSTWEGYFDFWGQGTMVTVSS

SEQ ID NO: 2891 - protein, 121 aa, Artificial Sequence
  Description of Artificial Sequence: Synthetic heavy chain variable domain
QVQLQQSGAELAKPGVSVKMSCKASGYTSNYNWIHWIKQRPGQGLEWIGYINPATGYTDYNQKERDKVTLTADKSSSTAYMQLSSLTSEDSALYYCTTGRNDEGGYALDSWGQGTSVTVSS

SEQ ID NO: 2892 - protein, 117 aa, Artificial Sequence
  Description of Artificial Sequence: Synthetic heavy chain variable domain
EVQLVESGGGLVQPGGSLKLSCAASGFIFSGYGMSWVRQTPDKRLELVAIINSNGGSVDYPDSVKGRVTISRDNAKNTLYLQMSSLKSEDTAMYYCARIYYRCMDYWGQGTSVTVSS

SEQ ID NO: 2893 - protein, 120 aa, Artificial Sequence
  Description of Artificial Sequence: Synthetic heavy chain variable domain
QIQLQQSGPELVKPGASVKISYKASGYTFTDYYINWVKQKPGQGLEWIGWIYPGSGITKYNEKFKGKATLTVDSSSSTAYMQLSSLTSEDTAVYFCAIYGYDGGYAMDYWGQGTSVTVSS

SEQ ID NO: 2894 - protein, 117 aa, Artificial Sequence
  Description of Artificial Sequence: Synthetic heavy chain variable domain
EVQLQQSGAELVRPGALVKLSCKASGFNIKHYYIHWVNQRPEQGLEWIGWIDPETGNTIYDPKFQGKASITADTSSSTAYLQLNSLTSEDTAVYCCARGWSYAMDYWGQGTSVIVSS

SEQ ID NO: 2895 - protein, 123 aa, Artificial Sequence
  Description of Artificial Sequence: Synthetic heavy chain variable domain
EVKLVESGGGLVQPGGSLNLSCAASGFTFSSYTMSWVRQTPEKRLEWVAYISSGGHSTYFPDTVKGRFTISRDNAKNTLYLQMSSLKSEDTAVYYCARGGYGNYGPYYNMDYWGQGTSVTVSS

SEQ ID NO: 2896 - protein, 117 aa, Artificial Sequence
  Description of Artificial Sequence: Synthetic heavy chain variable domain
SDVQLQESGPGLVKPSQSLSLTCTVTGYSITSDYAWNWIRQFPGNKLEWMGYISYSGSISYNPSLKSRISITRDTSKNQFFLQLNSVTTEDTATYYCARSGRLRRDFDYWGQGTTLT

SEQ ID NO: 2897 - protein, 122 aa, Artificial Sequence
  Description of Artificial Sequence: Synthetic heavy chain variable domain
EVKLLESGGGLVQPGGSLKLSCAASGFDFSRYWMSWVRQAPGKGLEWIGEINPDSSTINYTPSLKDKFIISRDNAKNTLFLQMSKVRSEDTALYYCARPSYDGYYGYAMDYWGQGTSVTVSS

SEQ ID NO: 2898 - protein, 123 aa, Artificial Sequence
  Description of Artificial Sequence: Synthetic heavy chain variable domain
EVNLVESGGGLVQPGGSLKLSCAASGFTFSSYTMSWVRQSPEKRLEWVAYTSSSGASTYYPDTVKGRFTISRDNAKNTLHLQMSSLKSEDTAMYYCARGGYGNYGPYYALDYWGQGTSVTVSS

SEQ ID NO: 2899 - protein, 119 aa, Artificial Sequence
  Description of Artificial Sequence: Synthetic heavy chain variable domain
EVQLQQSGPELVKPGASVKISCKASGYSFTGYLMNWVMQSHGKSLEWIGRINPYNGDIFYNQKFKDKATLTVDKSSSTAHMELRSLASEDSAVYYCARRDENFDYDNAMDYWGQGTSVT

SEQ ID NO: 2900 - protein, 121 aa, Artificial Sequence
  Description of Artificial Sequence: Synthetic heavy chain variable domain
QVQLQQSGAELAKPGVSVKMSCKASGYTSNYNWIHWIKQRPGQGLEWIGYINPATGYTDYNQKFRDKVTLTADKSSSTAYMQLSSLTSEDSALYYCTTGRNDEGGYALDSWGQGTSVTVSS

SEQ ID NO: 2901 - protein, 118 aa, Artificial Sequence
  Description of Artificial Sequence: Synthetic heavy chain variable domain
QVQLQQSGPELVRPGPSMRMSCKASGYTFTSYWMYWVKKRPGQGLEWIGMIDPSKSETRLNQKCEDKATLNGEKASNTAYMEVSSLTSDDSAVHYCAQYGNHVLLLTGAKGHRSLSLH

SEQ ID NO: 2902 - protein, 119 aa, Artificial Sequence
  Description of Artificial Sequence: Synthetic heavy chain variable domain
EVQLQQSGAELVRPGALVKLSCKASGFNIKDYYMYWMKQRPEQGLEWIGWIDPENVKTIYDPKFQGRATLTADTSSNTAYLQLSSLTSEDTAVYYCTRDFGYVGFFDVWGAGTTVTVSS

SEQ ID NO: 2903 - protein, 121 aa, Artificial Sequence
  Description of Artificial Sequence: Synthetic heavy chain variable domain
EVMLVESGGGLVKPGGSLKLSCAASGFTFSSYAMSWVRQTPERKLEWVATISSGGTYTYYPDSVKGRFTISRDNAKNRLYLQMSGLRSEGTAMYYCVRPDYTHDDGGFAYWGQGTLVTVSA

SEQ ID NO: 2904 - protein, 117 aa, Artificial Sequence
  Description of Artificial Sequence: Synthetic heavy chain variable domain
QVQLKQSGPELEKPGASVKISCKASGYSFTGYNMNWVKQSNGKSLEWIGNIDPYYGGTSYNQKFKGKATLTVDKSSNTAYMHLKSLTSEDSAVYYCARDSSSWFAYWGQGTLVTVSA

SEQ ID NO: 2905 - protein, 121 aa, Artificial Sequence
  Description of Artificial Sequence: Synthetic heavy chain variable domain
EVQLQQSGAELMKPGASVKISCKATGYTFSSYWIEWVKQRPGHGLEWIGEILPGSASTKYNEKFKGKATFTADTSSNTAYMQLSSLTSEDSAVYYCARDYYYGSSYGFAYWGQGTLVTVSS

SEQ ID NO: 2906 - protein, 118 aa, Artificial Sequence
  Description of Artificial Sequence: Synthetic heavy chain variable domain
QVQLQQPGAELVKPGASVKLSCKTSGYTFTSYWMHWVKQRPGQGLEWIGEIDPSDSYTNYNQKFKGKATLTVDKSSSTAYMQLSSLTSEDSAVYYCTYYVNYYAMDYWGQGTSVTVSS

SEQ ID NO: 2907 - protein, 120 aa, Artificial Sequence
  Description of Artificial Sequence: Synthetic heavy chain variable domain
QVQLKESGAELMKPGASVKISCKATGYTFSSYWIEWVKQRPGHGLEWIGEILPGSGSTNYNEKFKGKATFTADTSSNTAYMQLSSLTSEDSAVYYCARDRNGYVNYFDSWGQGTTLTVSS

SEQ ID NO: 2908 - protein, 117 aa, Artificial Sequence
  Description of Artificial Sequence: Synthetic heavy chain variable domain
DVKLQESGPDLVKPSQSLSLTCTVTGYSITSGYSWHWIRQFPGNKLEWMGYIHYSGSTKYNPSLKSRISITRDTSKNQFFLQLNSVTTEDTATYYCARLWSWYFDVWGAGTTVTVSS

SEQ ID NO: 2909 - protein, 116 aa, Artificial Sequence
  Description of Artificial Sequence: Synthetic heavy chain variable domain
QVQLKQSGAELMKPGASVKISCKATGYTFSSYWIEWVKQRPGHGLEWIGEILPGSGSTNYNEKFKGKATFTADTSSNTAYMQLSSLTSEDSAVYYCAREDRYDGDYWGQGTTLTVS

SEQ ID NO: 2910 - protein, 226 aa, Artificial Sequence
  Description of Artificial Sequence: Synthetic heavy chain variable domain
EVQLVESGGGLVQPGGSLRLSCAASGFNIKEYYMEIWVRQSPGKGLEWVGLIDPEQGNTIYDPKFQDRATISADNSKNTAYLQMNSLRAEDTAIYYCARDTAAYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 2911 - protein, 106 aa, Artificial Sequence
  Description of Artificial Sequence: Synthetic heavy chain variable domain
QIVLTQSPAIMSASPGEKVTITCSASSSVSYMHWFQQKPGTSPKLWIYSTSNLASGVPARFSGSGSGTSYSLTISRMEAEDAATYYCQQRSSYPFTFGSGTKLEIK

SEQ ID NO: 2912 - protein, 114 aa, Artificial Sequence
  Description of Artificial Sequence: Synthetic heavy chain variable domain
QVQLEESGPGLVAPSQSLSITCTVSGFSLTSYGVSWVRQPPGKGLEWLGVIWGDGSTNYHSALISRLSISKDNSKSQVFLKLNSLQTDDTATYYCAKGGYFDYWGQGTTLTVSS

SEQ ID NO: 2913 - protein, 124 aa, Artificial Sequence
  Description of Artificial Sequence: Synthetic heavy chain variable domain
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSS

SEQ ID NO: 2914 - protein, 122 aa, Artificial Sequence
  Description of Artificial Sequence: Synthetic heavy chain variable domain
EVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSS

SEQ ID NO: 2915 - protein, 119 aa, Artificial Sequence
  Description of Artificial Sequence: Synthetic heavy chain variable domain
QIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSS

SEQ ID NO: 2916 - protein, 117 aa, Artificial Sequence
  Description of Artificial Sequence: Synthetic heavy chain variable domain
QVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSS

SEQ ID NO: 2917 - protein, 120 aa, Artificial Sequence
  Description of Artificial Sequence: Synthetic heavy chain variable domain
EVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSS

SEQ ID NO: 2918 - protein, 229 aa, Artificial Sequence
  Description of Artificial Sequence: Synthetic heavy chain variable domain
EVQLQQSGGGLVKTGASVKISCKASGYSFTSYYMEIWVKQSHGKSLEWIGEINPYNGGASYNQKIKGRATFTVDTSSRTAYMQFNSLTSEDSAIYYCARSIYGHSVLDYWGQGTSVSVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCIC

SEQ ID NO: 2919 - protein, 158 aa, Artificial Sequence
  Description of Artificial Sequence: Synthetic heavy chain variable domain
MLLLVTSLLLCELPHPAFLLIPQRLVESGGGVVQPGSSLRLSCAASGFDFSRQGMHWVRQAPGQGLEWVAFIKYDGSEKYHADSVWGRLSISRDNSKDTLYLQMNSLRVEDTATYFCVREAGGPDYRNGYNYYDFYDGYYNYHYMDVWGKGTTVTVSS

SEQ ID NO: 2920 - protein, 137 aa, Artificial Sequence
  Description of Artificial Sequence: Synthetic heavy chain variable domain
MEWSWIFLFLLSGTAGVHSEVQLQQSGPELVKPGASVKMSCKASGDTFTTYVIHWMKQKPGQGLEWIGYINPYNDGTKYNEKFKGKATLISDKSSSIAYMELSSLTSEDSAVYYCARIYYDYDGDYWGQGTTLIVSS

SEQ ID NO: 2921 - protein, 137 aa, Artificial Sequence
  Description of Artificial Sequence: Synthetic heavy chain variable domain
MEWSWIFLFLLSGTAGVHSEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSS

SEQ ID NO: 2922 - protein, 117 aa, Artificial Sequence
  Description of Artificial Sequence: Synthetic heavy chain variable domain
QVQPQQPGAELVKPGASVKMSCKASGDTFTNSWIGWVTQRPGQGLEWIGDIFPGSGHTNYNEKFKNRATLTVDTSSSTAYMLLSSLTSDDSAVYYCVIENYAWFAYWGQGTLVTVSA

SEQ ID NO: 2923 - protein, 119 aa, Artificial Sequence
  Description of Artificial Sequence: Synthetic heavy chain variable domain
QVQLQQSGPELVKPGTSVRISCKASGYTFTTFYIHWVKQRPGQGLEWIGWFYPGNVNTNYNEKLKGKATLTADKSSSAAYLQLNSLTSEDSAVYFCTRSPYYGYVFDYWGQGTTLTVSS

SEQ ID NO: 2924 - protein, 122 aa, Artificial Sequence
  Description of Artificial Sequence: Synthetic heavy chain variable domain
QVQLQQPGTELVKPGASVKLSCKASGYTFTGFWIHWVKQRPGQGLEWIGHINPGNGGTNYNEKFKRMATLTVDKSSSTAYMQLSSLTSEDSAVYYCARSYSNYVRAMDTYIWGQGTSVTVSS

SEQ ID NO: 2925 - protein, 119 aa, Artificial Sequence
  Description of Artificial Sequence: Synthetic heavy chain variable domain
QVQLQQSGPELVKPGASVRISCKASGYTFTTFYIHWVKQRPGQGLEWIAWFYPGNVNTNYNEKFKDKATLTADKSSSAAYLQLNSLTSEDSAVYFCTRSPYYGYVFDFWGQGTTLTVSS

SEQ ID NO: 2926 - protein, 127 aa, Artificial Sequence
  Description of Artificial Sequence: Synthetic heavy chain variable domain
KLQVQLQESGPELVKPGASVKMSCKASGYTFTSYVFHWVKQKPGQGLEWIGYINPYNDVTKYNEKFKGKATLTSDKSSSTAYMELSSLTSEDSAVYYCASYYGSSYGYYAMDDWGQGTTVTVSSGGG

SEQ ID NO: 2927 - protein, 127 aa, Artificial Sequence
  Description of Artificial Sequence: Synthetic heavy chain variable domain
EVQLLESGGGLVQPGGSLRLSCAASGFTFSGYAMSWVRQAPGKGLEWVSSIYSSSGSKYYADSVKGRFTISRDNSKNTLYLQMNSLRAEDTAVYYCARASSTCTRTWCSYDDAMDVWGQGTLVTVSS

SEQ ID NO: 2928 - protein, 121 aa, Artificial Sequence
  Description of Artificial Sequence: Synthetic heavy chain variable domain
EVQLLESGGGLVQTGGSLRLSCAASGFTFSDYAMSWVRQAPGKGLEWVSSIYPGSGSKYYADSVKGRFAISRDNSKNTLYLQMNSLRAEDTAVYYCARDAWFRGHNVFDYWGQGTLVTVSS

SEQ ID NO: 2929 - protein, 127 aa, Artificial Sequence
  Description of Artificial Sequence: Synthetic heavy chain variable domain
EVQLLESGGGLVQPGGSLRLSCAASGFTFSNYDMSWVRQAPGKGLEWVSGIYPNGGSKYYADSVKGRFTISRDNSKNTLYLQMNSLRAEDTAVYYCARALRQCQRYWCSYADGMDVWGQGTLVTVSS

SEQ ID NO: 2930 - protein, 121 aa, Artificial Sequence
  Description of Artificial Sequence: Synthetic heavy chain variable domain
EVQLLESGGGLVQPGGSLRLSCAASGFTFSDYYMSWVRQAPGKGLEWVSAIYSGGGSIYYADSVKGRFTISRDNSKNTLYLQMNSLRAEDTAVYYCARDVQWNKAPRFDYWGQGTLVTVSS

SEQ ID NO: 2931 - protein, 121 aa, Artificial Sequence
  Description of Artificial Sequence: Synthetic heavy chain variable domain
EVQLLESGGGLVQPGGSLRLSCAASGFTFSSYSMSWVRQAPGKGLEWVSGISHGGGNKYYADSVKGRFTISRDNSKNTLYLQMNSLRAEDTAVYYCARDLRANNDTGFDYWGQGTLVTVSS

SEQ ID NO: 2932 - protein, 127 aa, Artificial Sequence
  Description of Artificial Sequence: Synthetic heavy chain variable domain
EVQLLESGGGLVQPGGSLRLSCAASGFTFSNYDMSWVRQAPGKGLEWVSLISHGGGNIYYADSVKGRFTISRDNSKNTLYLQMNSLRAEDTAVYYCARVPVMCTNHWCSYANGMDVWGQGTLVTVSS

SEQ ID NO: 2933 - protein, 121 aa, Artificial Sequence
  Description of Artificial Sequence: Synthetic heavy chain variable domain
EVQLLESGGGLVQPGGSLRLSCAASGFTFSGYAMSWVRQAPGKGLEWVSGISHDGGNTYYADSVKGRFTISRDNSKNTLYLQMNSLRAEDTAVYYCARDRRKGPSTEFDYWGQGTLVTVSS

SEQ ID NO: 2934 - protein, 127 aa, Artificial Sequence
  Description of Artificial Sequence: Synthetic heavy chain variable domain
EVQLLESGGGLVQTGGSLRLSCAASGFTFSDYAMSWVRQAPGKGLEWVSWIYPGDSSIYYADSVKGRFTISRDNSKNTLYLQMNSLRAEDTAVYYCARLLSIDQAQLHYYYDAMDVWGQGTLVTVSS

SEQ ID NO: 2935 - protein, 161 aa, Artificial Sequence
  Description of Artificial Sequence: Synthetic heavy chain variable domain
EVQLVQSGAEVKKPGSSVKVSCKASGGTFSSYAISWVRQAPGQGLEWMGGIIPIFGTAYAQKFQGRVTITADESTSTAYMELSSLRSEDTAVYYCARVGATTSLYYYYGMDVWGQGTTVTVSSASTKGPSVFPLAPSSKSTSGGTAALGCLVKDYFPEPVT

SEQ ID NO: 2936 - protein, 159 aa, Artificial Sequence
  Description of Artificial Sequence: Synthetic heavy chain variable domain
EVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARGIIVGPTDAFDIWGQGTTVTVSSASTKGPSVFPLAPSSKSTSGGTAALGCLVKDYFPEPVT

SEQ ID NO: 2937 - protein, 155 aa, Artificial Sequence
  Description of Artificial Sequence: Synthetic heavy chain variable domain
QVQLVQSGGGLVQPGGSLRLSCAASGFSFSTYAMSWVRQAPGKGLEWVSGISGSGGATHYADSVKGRFTISRDNSKNTVNLQMNSLRAEDTAVYYCAKGLWFGEGYWGQGTLVTVSSASTKGPSVFPLAPSSKSTSGGTAALGCLVKDYFPEPVT

SEQ ID NO: 2938 - protein, 160 aa, Artificial Sequence
  Description of Artificial Sequence: Synthetic heavy chain variable domain
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGSLGVGYYYMDFWGKGTTVTVSSASTKGPSVFPLAPSSKSTSGGTAALGCLVKDYFPEPVT

SEQ ID NO: 2939 - protein, 155 aa, Artificial Sequence; identical to SEQ ID NO: 2937
  Description of Artificial Sequence: Synthetic heavy chain variable domain

SEQ ID NO: 2940 - protein, 155 aa, Artificial Sequence
  Description of Artificial Sequence: Synthetic heavy chain variable domain
QVQLVQSGGGLVQPGGSLRLSCAASGFSFSTYAMSWVRQAPGKGLEWVSGISGSGGATHYADSVKGRFTISRDNSKNTVNLQMNSLRAEDTAVYYCAKGLWFGEGLWGQGTLVTVSSASTKGPSVFPLAPSSKSTSGGTAALGCLVKDYFPEPVT

SEQ ID NO: 2941 - protein, 155 aa, Artificial Sequence
  Description of Artificial Sequence: Synthetic heavy chain variable domain
QVQLVQSGGGLVQPGGSLRLSCAASGFSFSTYAMSWVRQAPGKGLEWVSGISGSGGATHYADSVKGRFTISRDNSKNTVNLQMNSLRAEDTAVYYCAKGLWFGEGIWGQGTLVTVSSASTKGPSVFPLAPSSKSTSGGTAALGCLVKDYFPEPVT

SEQ ID NO: 2942 - protein, 155 aa, Artificial Sequence
  Description of Artificial Sequence: Synthetic heavy chain variable domain
QVQLVQSGGGLVQPGGSLRLSCAASGFTFSTYAMSWVRQAPGKGLEWVSGINGSGGATHYADSVKGRFTISRDNSKNTVNLQMNSLRAEDTAVYYCAKGLWFGEGYWGQGTLVTVSSASTKGPSVFPLAPSSKSTSGGTAALGCLVKDYFPEPVT

SEQ ID NO: 2943 - protein, 155 aa, Artificial Sequence
  Description of Artificial Sequence: Synthetic heavy chain variable domain
QVQLVQSGGGLVQPGGSLRLSCAASGFTFSTYAMSWVRQAPGKGLEWVSGINGSGGATHYADSVKGRFTISRDNSKNTVNLQMNSLRAEDTAVYYCAKGLWFGEGLWGQGTLVTVSSASTKGPSVFPLAPSSKSTSGGTAALGCLVKDYFPEPVT

SEQ ID NO: 2944 - protein, 155 aa, Artificial Sequence
  Description of Artificial Sequence: Synthetic heavy chain variable domain
QVQLVQSGGGLVQPGGSLRLSCAASGFSFSTYAMSWVRQAPGKGLEWVSGISGSSGATHYADSVKGRFTISRDNSKNTVNLQMNSLRAEDTAVYYCAKGLWFGEGYWGQGTLVTVSSASTKGPSVFPLAPSSKSTSGGTAALGCLVKDYFPEPVT

SEQ ID NO: 2945 - protein, 155 aa, Artificial Sequence
  Description of Artificial Sequence: Synthetic heavy chain variable domain
QVQLVQSGGGLVQPGGSLRLSCAASGFSFSTYAMSWVRQAPGKGLEWVSGISGSSGATHYADSVKGRFTISRDNSKNTVNLQMNSLRAEDTAVYYCAKGLWFGEGLWGQGTLVTVSSASTKGPSVFPLAPSSKSTSGGTAALGCLVKDYFPEPVT

SEQ ID NO: 2946 - protein, 155 aa, Artificial Sequence
  Description of Artificial Sequence: Synthetic heavy chain variable domain
QVQLVQSGGGLVQPGGSLRLSCAASRFSFSTYAMSWVRQAPGKGLEWVSGISGSGQATHYADSVKGRFTISRDNSKNTVNLQMNSLRAEDTAVYYCAKGLWFGEGYWGQGTLVTVSSASTKGPSVFPLAPSSKSTSGGTAALGCLVKDYFPEPVT

SEQ ID NO: 2947 - protein, 155 aa, Artificial Sequence; identical to SEQ ID NO: 2946
  Description of Artificial Sequence: Synthetic heavy chain variable domain

SEQ ID NO: 2948 - protein, 155 aa, Artificial Sequence
  Description of Artificial Sequence: Synthetic heavy chain variable domain
QVQLVQSGGGLVQPGGSLRLSCAASGFSFSTYAMSWVRQAPGKGLEWVSGISGSGGTTHYADSVKGRFTISRDNSKNTVNLQMNSLRAEDTAVYYCAKGLWFGEGYWGQGTLVTVSSASTKGPSVFPLAPSSKSTSGGTAALGCLVKDYFPEPVT

SEQ ID NO: 2949 - protein, 155 aa, Artificial Sequence
  Description of Artificial Sequence: Synthetic heavy chain variable domain
QVQLVQSGGGLVQPGGSLRLSCAASGFSFSTYAMSWVRQAPGKGLEWVSGISGSGGTTHYADSVKGRFTISRDNSKNTVNLQMNSLRAEDTAVYYCAKGLWFGEGLWGQGTLVTVSSASTKGPSVFPLAPSSKSTSGGTAALGCLVKDYFPEPVT

SEQ ID NO: 2950 - protein, 158 aa, Artificial Sequence
  Description of Artificial Sequence: Synthetic heavy chain variable domain
EVQLVQSGAEVKKPGASVKVSCRASGFSFTTYYMHWVRQAPGQGLEWMGIINPSGGSTSYAQKFQGRVTMTRDTSTSTVYMELSSLRSEDTAVYYCARDLVVPAATLDYWGQGTLVTVSSASTKGPSVFPLAPSSKSTSGGTAALGCLVKDYFPEPVT

SEQ ID NO: 2951 - protein, 156 aa, Artificial Sequence
  Description of Artificial Sequence: Synthetic heavy chain variable domain
EVQLVQTGGGAVQPGRSLRLSCAATGFTFSSYGMHWVRQAPGKGLEWVAVISYDGSNKYYADSVKGRFTISRDNAKNTLYLQMNSLRAEDTAVYYCARESYGGQFDYWGPGTLVTVSSASTKGPSVFPLAPSSKSTSGGTAALGCLVKDYFPEPVT

SEQ ID NO: 2952 - protein, 163 aa, Artificial Sequence
  Description of Artificial Sequence: Synthetic heavy chain variable domain
EVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDGFGLAVAGPYWYFDLWGRGTLVTVSSASTKGPSVFPLAPSSKSTSGGTAALGCLVKDYFPEPVT

SEQ ID NO: 2953 - protein, 166 aa, Artificial Sequence
  Description of Artificial Sequence: Synthetic heavy chain variable domain
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCAGPTRSRDFWSGLGYYYYMDVWGKGTTVTVSSASTKGPSVFPLAPSSKSTSGGTAALGCLVKDYFPEPVT

SEQ ID NO: 2954 - protein, 159 aa, Artificial Sequence
  Description of Artificial Sequence: Synthetic heavy chain variable domain
EVQLVQSGGGVVQPGRSLRLSCAASGFTFSSYGMHWVRQAPGKGLEWVAVISYDGSNKHYADSVKGRFTISRDNSKNTLYLQMNSLRAEDTAVYYCARDFYEAGGWYFDLWGRGTLVTVSSASTKGPSVFPLAPSSKSTSGGTAALGCLVKDYFPEPVT

SEQ ID NO: 2955 - protein, 120 aa, Artificial Sequence
  Description of Artificial Sequence: Synthetic heavy chain variable domain
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSSYGWSYEFDYWGQGTLVTVSS

SEQ ID NO: 2956 - protein, 119 aa, Artificial Sequence
  Description of Artificial Sequence: Synthetic heavy chain variable domain
QVQLVQSGSELKKPGASVKVSCKASGYTFTNYGLNWVRQAPGQGLEWMGWINPYTGEPTYADDFKGRFVFSLDTSVSTAYLQICSLKAEDTAVYYCAREGYGNYIFPYWGQGTLVTVSS

SEQ ID NO: 2957 - protein, 122 aa, Artificial Sequence
  Description of Artificial Sequence: Synthetic heavy chain variable domain
QVQLVQSGAEVKPGASVKVSCKASGYTFTHYTIHWVRQAPGQGLEWMGYIIPSSGYSEYNQKFKDRVTMTRDTSTSTVYMELSSLRSEDTAVYYCARGAYDDYYDYYAMDYWGQGTLVTVSS

SEQ ID NO: 2958 - protein, 122 aa, Artificial Sequence
  Description of Artificial Sequence: Synthetic heavy chain variable domain
EVQLVESGGGLVQPGGSLRLSCAASGFTFRNYGMSWVRQAPGKGLEWVASIISGGSYTYYPDSVKGRFTISRDNAKNSLYLQMNSLRAEDTAVYYCARIYDHDGDYYAMDYWGQGTTVTVSS

SEQ ID NO: 2959 - protein, 136 aa, Artificial Sequence
  Description of Artificial Sequence: Synthetic heavy chain variable domain
MAWVWTLLFLMAAAQSIQAQIQLVQSGPELKKPGETVKISCKASGYTFTNYGMNWVKQAPGKGLKWMGWINTDSGESTYAEEFKGRFAFSLETSANTAYLQINNLNNEDTATYFCVRVGYDALDYWGQGTSVTVSS

SEQ ID NO: 2960 - protein, 118 aa, Artificial Sequence
  Description of Artificial Sequence: Synthetic heavy chain variable domain
EVQLVETGGGLLQPGGSLRLSCAASGFSVSGTYMGWVRQAPGKGLEWVALLYSGGGTYHPASLQGRFIVSRDSSKNMVYLQMNSLKAEDTAVYYCAKGGAGGGHFDSWGQGTLVTVSS

SEQ ID NO: 2961 - protein, 107 aa, Artificial Sequence
  Description of Artificial Sequence: Synthetic heavy chain variable domain
DDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 2962 - protein, 451 aa, Artificial Sequence
  Description of Artificial Sequence: Synthetic heavy chain variable domain
QMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 2963 - protein, 119 aa, Artificial Sequence
  Description of Artificial Sequence: Synthetic heavy chain variable domain
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSS

SEQ ID NO: 2964 - protein, 121 aa, Artificial Sequence
  Description of Artificial Sequence: Synthetic heavy chain variable domain
QVQLQQSGPGLVKPSQTLSLTCAISGDSVSSNSAAWNWIRQSPSRGLEWLGRTYYGSKWYNDYAVSVKSRITINPDTSKNQFSLQLNSVTPEDTAVYYCARGRLGDAFDIWGQGTMVTVSS

SEQ ID NO: 2965 - protein, 121 aa, Artificial Sequence
  Description of Artificial Sequence: Synthetic heavy chain variable domain
QMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSS

SEQ ID NO: 2966 - protein, 118 aa, Artificial Sequence
  Description of Artificial Sequence: Synthetic heavy chain variable domain
QVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSS

SEQ ID NO: 2967 - protein, 121 aa, Artificial Sequence
  Description of Artificial Sequence: Synthetic heavy chain variable domain
EVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSS

SEQ ID NO: 2968 - protein, 118 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTV

SEQ ID NO: 2969 - protein, 119 aa, Artificial Sequence
  Description of Artificial Sequence: Synthetic heavy chain variable domain
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTV

SEQ ID NO: 2970 - protein, 122 aa, Artificial Sequence; identical to SEQ ID NO: 836
  Description of Artificial Sequence: Synthetic heavy chain variable domain

SEQ ID NO: 2971 - protein, 121 aa, Artificial Sequence [sequence omitted]

SEQ ID NO: 2972 - protein, 122 aa, Artificial Sequence
  Description of Artificial Sequence: Synthetic heavy chain variable domain
QVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSSA

SEQ ID NO: 2973 - protein, 122 aa, Artificial Sequence
  Description of Artificial Sequence: Synthetic heavy chain variable domain
EVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSA

SEQ ID NO: 2974 - protein, 122 aa, Artificial Sequence
  Description of Artificial Sequence: Synthetic heavy chain variable domain
EVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGSSYGVLFAYWGQGTLVTVSA

SEQ ID NO: 2975 - protein, 116 aa, Artificial Sequence
  Description of Artificial Sequence: Synthetic heavy chain variable domain
LQQSGAELVKPGASVRLSCKASGYTFTEYIIHWIKLRSGQGLEWIGWFYPGSNDIQYNAKFKGKATLTADKSSSTVYMELTGLTSEDSAVYFCARRDDFSGYDALPYWGQGTMVTV

SEQ ID NO: 2976 - protein, 115 aa, Artificial Sequence; identical to SEQ ID NO: 951
  Description of Artificial Sequence: Synthetic heavy chain variable domain

SEQ ID NO: 2977 - protein, 117 aa, Artificial Sequence; identical to SEQ ID NO: 952
  Description of Artificial Sequence: Synthetic heavy chain variable domain

SEQ ID NO: 2978 - protein, 120 aa, Artificial Sequence; identical to SEQ ID NO: 953
  Description of Artificial Sequence: Synthetic heavy chain variable domain

SEQ ID NO: 2979 - protein, 118 aa, Artificial Sequence; identical to SEQ ID NO: 954
  Description of Artificial Sequence: Synthetic heavy chain variable domain

SEQ ID NO: 2980 - protein, 120 aa, Artificial Sequence; identical to SEQ ID NO: 2917
  Description of Artificial Sequence: Synthetic heavy chain variable domain

SEQ ID NO: 2981 - protein, 119 aa, Artificial Sequence; identical to SEQ ID NO: 2915
  Description of Artificial Sequence: Synthetic heavy chain variable domain

SEQ ID NO: 2982 - protein, 117 aa, Artificial Sequence; identical to SEQ ID NO: 2916
  Description of Artificial Sequence: Synthetic heavy chain variable domain

SEQ ID NO: 2983 - protein, 122 aa, Artificial Sequence; identical to SEQ ID NO: 2914
  Description of Artificial Sequence: Synthetic heavy chain variable domain

SEQ ID NO: 2984 - protein, 107 aa, Artificial Sequence
  Description of Artificial Sequence: Synthetic heavy chain variable domain
DIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIK

SEQ ID NO: 2985 - protein, 115 aa, Artificial Sequence
  Description of Artificial Sequence: Synthetic heavy chain variable domain
QVQVKESGPGLVAPSQSLSITCTVSGFSLTTSGVSWVRQPPGKGLEWLGVIWGDGSTNYHSALKSRLSIKKDHSKSQVFLKLNSLQTDDTATYYCAKGGYSLAHWGQGTLVTVSA

SEQ ID NO: 2986 - protein, 115 aa, Artificial Sequence
  Description of Artificial Sequence: Synthetic heavy chain variable domain
QVQVQESGPGLVAPSQTLSITCTVSGFSLTTSGVSWVRQPPGKGLEWLGVIWGDGSTNYHPSLKSRLSIKKDHSKSQVFLKLNSLTAADTATYYCAKGGYSLAHWGQGTLVTVSS

SEQ ID NO: 2987 - protein, 444 aa, Artificial Sequence
  Description of Artificial Sequence: Synthetic heavy chain variable domain
QVQVQESGPGLVAPSQTLSITCTVSGFSLTTSGVSWVRQPPGKGLEWLGVIWGDGSTNYHPSLKSRLSIKKDHSKSQVFLKLNSLTAADTATYYCAKGGYSLAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2988 - protein, 447 aa, Artificial Sequence
  Description of Artificial Sequence: Synthetic heavy chain variable domain
QVQLVESGGGVVQPGRSLRLSCATSGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2989 - protein, 450 aa, Artificial Sequence
  Description of Artificial Sequence: Synthetic heavy chain variable domain
EVQLVESGGGLVQPGRSLRLSCAASGFTFDDYAMHWVRQAPGKGLEWVSGISWKSGSIGYADSVKGRFTISRDNAKNSLYLQMNSLRAEDTALYYCVKGYYVILTGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2990 - protein, 448 aa, Artificial Sequence
  Description of Artificial Sequence: Synthetic heavy chain variable domain
QVQLVESGGGVVQPGRSLRLSCAASGFTFSNYGMHWVRQAPGKGLEWVAVIWYDESNKYYADSVKGRFTISRDNSKNTLFLQMNSLRAEDTAVYYCARGYNSRWYPDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2991 - protein, 448 aa, Artificial Sequence
  Description of Artificial Sequence: Synthetic heavy chain variable domain
QVQLVESGGGVVQPGRSLRLSCAASGFTFSNYGLHWVRQAPGKGLEWVAVIRYDGSNKYYADSVKGRFTISRDNSKNTLYLQMSSLRAEDTAVYYCARGGSSWYPDGLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2992 - protein, 450 aa, Artificial Sequence
  Description of Artificial Sequence: Synthetic heavy chain variable domain
EVQLVESGGNLVQPGRSLRLSCAASGFTFDDYAMHWVRQAPGKGLEWVSGISWNNNDIGYADSVKGRFIISRDNAKNSLYLQMNSLRPEDTALYYCVKGYYVILTGLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2993 - protein, 448 aa, Artificial Sequence
  Description of Artificial Sequence: Synthetic heavy chain variable domain
QVQLVESGGGVVQPGRSLRLSCAASGFTFSNYGMHWVRQAPGKGLEWVAVIWYDGGNKYYADSVKGRFTISRDNSKNTLFLQMNSLRAEDTAVYYCARGGSSWYPDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2994 - protein, 449 aa, Artificial Sequence
  Description of Artificial Sequence: Synthetic heavy chain variable domain
EVQLVESGGGLVQPGGSLRLSCAASGFTFSSYWMHWVRQAPGKGLVWVSRIISDGSSTGYADSVKGRFTISRDNAKNTLYLQMNSLRAEDTAVYYCAREFSSGWYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2995 - protein, 451 aa, Artificial Sequence
  Description of Artificial Sequence: Synthetic heavy chain variable domain
EVQLVESGGALVQPGRSLRLSCAASGFTFDDYAMHWVRQAPGKGLEWVSGITWNSGGIGYADSVKGRFTISRDNAKNSLYLQMNSLRAEDTALYYCAKDRYYSSWLLFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2996 - protein, 451 aa, Artificial Sequence
  Description of Artificial Sequence: Synthetic heavy chain variable domain
EVQLVESGGGLVQTGRSLRLSCAASGFTFDDYAMHWVRQAPGKGLEWVSDISWNSDIIGYADSVKGRFTISRDNAKNSLYLQMNSLRAEDTALYYCAKDIYGSGSSFFDYWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2997 - protein, 120 aa, Artificial Sequence
  Description of Artificial Sequence: Synthetic heavy chain variable domain
EVQLVESGGGLVQPGRSLRLSCAASGFTFDDYAMHWVRQAPGKGLEWVSGISWKSGSIGYADSVKGRFTISRDNAKNSLYLQMNSLRAEDTALYYCVKGYYVILTGLDYWGQGTLVTVSS

SEQ ID NO: 2998 - protein, 122 aa, Artificial Sequence
  Description of Artificial Sequence: Synthetic heavy chain variable domain
QVQLVESGGGVVQPGRSLRLSCAASGFTFSNYGMHWVRQAPGKGLEWVAVIWYDESNKYYADSVKGRFTISRDNSKNTLFLQMNSLRAEDTAVYYCARGYNSRWYPDAFDIWGQGTMVTVSS

SEQ ID NO: 2999 - protein, 121 aa, Artificial Sequence
  Description of Artificial Sequence: Synthetic heavy chain variable domain
QVQLVESGGGVVQPGRSLRLSCATSGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS

SEQ ID NO: 3000 - protein, 120 aa, Artificial Sequence
  Description of Artificial Sequence: Synthetic heavy chain variable domain
EVQLVESGGNLVQPGRSLRLSCAASGFTFDDYAMHWVRQAPGKGLEWVSGISWNNNDIGYADSVKGRFIISRDNAKNSLYLQMNSLRPEDTALYYCVKGYYVILTGLDYWGQGTPVTVSS

SEQ ID NO: 3001 - protein, 121 aa, Artificial Sequence
  Description of Artificial Sequence: Synthetic heavy chain variable domain
QVQLVESGGGVVQPGRSLRLSCAASGFTFSNYGMHWVRQAPGKGLEWVAVIWYDGGNKYYADSVKGRFTISRDNSKNTLFLQMNSLRAEDTAVYYCARGGSSWYPDAFDIWGQGTMVTVSS

SEQ ID NO: 3002 - protein, 119 aa, Artificial Sequence
  Description of Artificial Sequence: Synthetic heavy chain variable domain
EVQLVESGGGLVQPGGSLRLSCAASGFTFSSYWMHWVRQAPGKGLVWVSRIISDGSSTGYADSVKGRFTISRDNAKNTLYLQMNSLRAEDTAVYYCAREFSSGWYFDYWGQGTLVTVSS

SEQ ID NO: 3003 - protein, 121 aa, Artificial Sequence
  Description of Artificial Sequence: Synthetic heavy chain variable domain
EVQLVESGGALVQPGRSLRLSCAASGFTFDDYAMHWVRQAPGKGLEWVSGITWNSGGIGYADSVKGRFTISRDNAKNSLYLQMNSLRAEDTALYYCAKDRYYSSWLLFDNWGQGILVTVSS

SEQ ID NO: 3004 - protein, 121 aa, Artificial Sequence
  Description of Artificial Sequence: Synthetic heavy chain variable domain
EVQLVESGGGLVQTGRSLRLSCAASGFTFDDYAMHWVRQAPGKGLEWVSDISWNSDIIGYADSVKGRFTISRDNAKNSLYLQMNSLRAEDTALYYCAKDIYGSGSSFFDYWGQGILVTVSS

SEQ ID NO: 3005 - protein, 120 aa, Artificial Sequence; identical to SEQ ID NO: 1035
  Description of Artificial Sequence: Synthetic heavy chain variable domain

SEQ ID NO: 3006 - protein, 120 aa, Artificial Sequence; identical to SEQ ID NO: 1036
  Description of Artificial Sequence: Synthetic heavy chain variable domain

SEQ ID NO: 3007 - protein, 120 aa, Artificial Sequence; identical to SEQ ID NO: 1041
  Description of Artificial Sequence: Synthetic heavy chain variable domain

SEQ ID NO: 3008 - protein, 120 aa, Artificial Sequence
  Description of Artificial Sequence: Synthetic heavy chain variable domain
QVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGSLVTVSS

SEQ ID NO: 3009 - protein, 467 aa, Artificial Sequence
  Description of Artificial Sequence: Synthetic heavy chain variable domain
MGWSCIILFLVATATGVHSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3010 - protein, 118 aa, Artificial Sequence
  Description of Artificial Sequence: Synthetic heavy chain variable domain
QVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSS

SEQ ID NO: 3011 - protein, 443 aa, Artificial Sequence
  Description of Artificial Sequence: Synthetic heavy chain variable domain
QVQLVQSGPEVKKPGASVKISCKASGYTFTDYSMHWVKKAPGQGLKWLGWINTATGEPTYADDFKGRFTITLDTSARTVYLEISSLRSEDTATYFCFSYYDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3012 - protein, 440 aa, Artificial Sequence
  Description of Artificial Sequence: Synthetic heavy chain variable domain
QIQLVQSGPEVKKPGASVKISCKASGYTFTDYSMHWVKKAPGQGLEWLGWINTATGEPTYADDFKGRFTITLDTSARTVYLQINNLRSEDTATYFCFSYYDYWGQGTLLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3013 - protein, 440 aa, Artificial Sequence
  Description of Artificial Sequence: Synthetic heavy chain variable domain
QVQLVQSGPEVKKPGASVKISCKASGYTFTDYSMHWVKKAPGQGLKWLGWINTATGEPTYADDFKGRFTITLDTSARTVYLEISSLRSEDTATYFCFSYYDYWGQGTLLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3014 - protein, 442 aa, Artificial Sequence
  Description of Artificial Sequence: Synthetic heavy chain variable domain
QIQLVQSGPELKKPGETVKISCKASGYTFTDYSMHWVKKTPGKGLKWLGWINTATGEPTYADDFKGRFAISLETSARTVYLQINNLRNEDTATYFCFSYYDYWGQGTTLTVSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3015 - protein, 214 aa, Artificial Sequence
  Description of Artificial Sequence: Synthetic heavy chain variable domain
DIKLSQSPSILSVTPGETVSLSCRASQTIYKNLHWYQQKSHRSPRLLIKYGSDSISGIPSRFTGSGSGTDYTLNINSVKPEDEGIYYCLQGYSTPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3016 - protein, 443 aa, Artificial Sequence
  Description of Artificial Sequence: Synthetic heavy chain variable domain
QIQLVQSGPEVKKPGASVKISCKASGYTFTDYSMHWVKKAPGQGLEWLGWINTATGEPTYADDFKGRFTITLDTSARTVYLQINNLRSEDTATYFCFSYYDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3017 - protein, 116 aa, Artificial Sequence; identical to SEQ ID NO: 2150
  Description of Artificial Sequence: Synthetic heavy chain variable domain

SEQ ID NO: 3018 - protein, 118 aa, Artificial Sequence; identical to SEQ ID NO: 2147
  Description of Artificial Sequence: Synthetic heavy chain variable domain

SEQ ID NO: 3019 - protein, 116 aa, Artificial Sequence
  Description of Artificial Sequence: Synthetic heavy chain variable domain
QVQLKESGGLVQPGGSLKLSCAASGFTFSSYGMSWVRQTADKRLELVATTNNNGGVTYYPDSVKGRFTISRDNAKNTLYLQMSSLQSEDTAMYYCARYGYYAMDYWGQGISVTVSS

SEQ ID NO: 3020 - protein, 119 aa, Artificial Sequence
  Description of Artificial Sequence: Synthetic heavy chain variable domain
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 3021 - protein, 115 aa, Artificial Sequence
  Description of Artificial Sequence: Synthetic heavy chain variable domain
QVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSA

SEQ ID NO: 3022 - protein, 117 aa, Artificial Sequence
  Description of Artificial Sequence: Synthetic heavy chain variable domain
EVQLVETGGGLVQPEGSLKLSCATSGFNFNTNAMNWVRQAPGKGLEWVARVRNKTNNYATYYADSVKDRFTISRDDSQRMVFLQMNNLKTEDTAIYYCVAGNSFAYWGQGTLVTVSP

SEQ ID NO: 3023 - protein, 117 aa, Artificial Sequence
  Description of Artificial Sequence: Synthetic heavy chain variable domain
EVQLVGSGGGLVQPEGSLKLSCAASGFTFKTNAMNWVRQAPGKGLEWVARIRNKTNNYATYYADSVKDRFTISRDDSQSMLYLQMNNLKTEDTAMYFCVAGNSFAYWGQGTLVTVSA

SEQ ID NO: 3024 - protein, 117 aa, Artificial Sequence
  Description of Artificial Sequence: Synthetic heavy chain variable domain
EVQLVETGGGLVQPKGSLKLSCAASGFTFNTNAMNWVRQAPGKGLQWVARVRNKTNNYATYYADSVKDRFTISRDDSQSMLYLQMNNLKTEDTAIYYCVGGNSFAYWGQGTLVTVSA

SEQ ID NO: 3025 - protein, 117 aa, Artificial Sequence
  Description of Artificial Sequence: Synthetic heavy chain variable domain
EVQLVGSGGGLVQPEGSLKLSCAASGFTFKTNAMNWVRQAPGKGLEWVARIRNKTNNYATYYADSVKDRFTISRDDSQSMLYLQMNNLKTEDTAMYFCVAGNSFAYLGQGTLVTVSA

SEQ ID NO: 3026 - protein, 117 aa, Artificial Sequence
  Description of Artificial Sequence: Synthetic heavy chain variable domain
EVQLVETGGGMVQPEGSLKLSCAASGFTFNKNAMNWVRQAPGKGLEWVARIRNKTNNYATYYADSVKARFTISRDDSQSMLYLQMNNLKIEDTAMYYCVAGNSFAYWGQGTLVTVSA

SEQ ID NO: 3027 - protein, 448 aa, Artificial Sequence
  Description of Artificial Sequence: Synthetic heavy chain variable domain
EVQLVQSGAEVKKPGASVKVSCKASGYSFTGYWMNWVRQAPGQGLEWIGMIHPLDAEIRANQKFRDRVTITVDTSTSTAYLELSSLRSEDTAVYYCARGTYDGGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3028 - protein, 448 aa, Artificial Sequence
  Description of Artificial Sequence: Synthetic heavy chain variable domain
EVQLVQSGAEVKKPGASVKVSCKASGYSFTGYWMNWVRQAPGQGLEWIGMIHPLDAEIRANQKFRDRVTITVDTSTSTAYLELSSLRSEDTAVYYCARGTYDGGFEYWGQGTLVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3029 - protein, 452 aa, Artificial Sequence
  Description of Artificial Sequence: Synthetic heavy chain variable domain
EVQLVQSGAEVKKPGATVKISCKVSGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3030 - protein, 452 aa, Artificial Sequence
  Description of Artificial Sequence: Synthetic heavy chain variable domain
QVQLVQSGAEVKKPGASVKVSCKASGFTLTNYGMNWVRQARGQRLEWIGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3031 - protein, 452 aa, Artificial Sequence
  Description of Artificial Sequence: Synthetic heavy chain variable domain
QVQLVQSGAEVKKPGASVKVSCKASGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3032 - protein, 451 aa, Artificial Sequence
  Description of Artificial Sequence: Synthetic heavy chain variable domain
EVQLVQSGAEVKKPGATVKISCKVSGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 3033 - protein, 451 aa, Artificial Sequence
  Description of Artificial Sequence: Synthetic heavy chain variable domain
QVQLVQSGAEVKKPGASVKVSCKASGFTLTNYGMNWVRQARGQRLEWIGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 3034 - protein, 452 aa, Artificial Sequence
  Description of Artificial Sequence: Synthetic heavy chain variable domain
EVQLVQSGAEVKKPGATVKISCKVSGFTLTNYGMNWIRQSPSRGLEWLGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3035 - protein, 452 aa, Artificial Sequence
  Description of Artificial Sequence: Synthetic heavy chain variable domain
EVQLVQSGAEVKKPGATVKISCKVSGFTLTNYGMNWVRQAPGQGLEWMGWINTDTGEPTYADDFKGRFVFSLDTSVSTAYLQICSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3036 - protein, 452 aa, Artificial Sequence
  Description of Artificial Sequence: Synthetic heavy chain variable domain
QVQLVQSGAEVKKPGASVKVSCKASGFTLTNYGMNWVRQARGQRLEWIGWINTDTGEPTYADDFKGRFVFSLDTSVSTAYLQICSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3037 - protein, 452 aa, Artificial Sequence
  Description of Artificial Sequence: Synthetic heavy chain variable domain
QVQLVQSGAEVKKPGASVKVSCKASGFTLTNYGMNWVRQAPGQGLEWMGWINTDTGEPTYADDFKGRFVFSLDTSVSTAYLQICSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3038 - protein, 452 aa, Artificial Sequence
  Description of Artificial Sequence: Synthetic heavy chain variable domain
EVQLVQSGAEVKKPGATVKISCKVSGFTLTNYGMNWIRQSPSRGLEWLGWINTDTGEPTYADDFKGRFVFSLDTSVSTAYLQICSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3039 - protein, 452 aa, Artificial Sequence
  Description of Artificial Sequence: Synthetic heavy chain variable domain
EVQLVQSGAEVKKPGESLRISCKGSGFTLTNYGMNWVRQATGQGLEWMGWINTDTGEPTYADDFKGRVTISADKSISTAYLQWSSLKASDTAMYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3040 - protein, 116 aa, Artificial Sequence
  Description of Artificial Sequence: Synthetic heavy chain variable domain
QVQLKESGPGLVQSSQTLSLTCTVSGFSLTSNGVSWVRQPPGKGLEWIAAISSGGSTYYNSAFKSRLSISPNTSKSQVLLKMNSLQTEDTGMYFCARHRPFYFDYWGQGVMVTVSS

SEQ ID NO: 3041 - protein, 116 aa, Artificial Sequence
  Description of Artificial Sequence: Synthetic heavy chain variable domain
QVTLKESGPVLVKPTETLTLTCTVSGFSLTSNGVSWVRQPPGKALEWIAAISSGGSTYYNSAFKSRLTISRDTSKSQVVLTMTNMDPVDTATYYCARHRPFYFDYWGQGTLVTVSS

SEQ ID NO: 3042 - protein, 116 aa, Artificial Sequence
  Description of Artificial Sequence: Synthetic heavy chain variable domain
QVTLKESGPVLVKPTETLTLTCTVSGFSLTSNGVSWVRQPPGKALEWIAAISSGGSTYYNSAFKSRLSISRDTSKSQVVLTMTNMDPVDTATYYCARHRPFYFDYWGQGTLVTVSS

SEQ ID NO: 3043 - protein, 116 aa, Artificial Sequence
  Description of Artificial Sequence: Synthetic heavy chain variable domain
QVTLKESGPVLVKPTETLTLTCTVSGFSLTSNGVSWVRQPPGKALEWIAAISSGGSTYYNSAFKSRLTISRNTSKSQVVLTMTNMDPVDTATYYCARHRPFYFDYWGQGTLVTVSS

SEQ ID NO: 3044 - protein, 116 aa, Artificial Sequence
  Description of Artificial Sequence: Synthetic heavy chain variable domain
QVTLKESGPVLVKPTETLTLTCTVSGFSLTSSGVSWVRQPPGKALEWIAAISSGGSTYYNSAFKSRLTISPDTSKSQVVLTMTNMDPVDTATYYCARHRPFYFDYWGQGTLVTVSS

SEQ ID NO: 3045 - protein, 116 aa, Artificial Sequence
  Description of Artificial Sequence: Synthetic heavy chain variable domain
QVTLKESGPVLVKPTETLTLTCTVSGFSLTSQGVSWVRQPPGKALEWIAAISSGGSTYYNSAFKSRLTISPDTSKSQVVLTMTNMDPVDTATYYCARHRPFYFDYWGQGTLVTVSS

SEQ ID NO: 3046 - protein, 116 aa, Artificial Sequence
  Description of Artificial Sequence: Synthetic heavy chain variable domain
QVTLKESGPVLVKPTETLTLTCTVSGFSLTSNAVSWVRQPPGKALEWIAAISSGGSTYYNSAFKSRLTISRDTSKSQVVLTMTNMDPVDTATYYCARHRPFYFDYWGQGTLVTVSS

SEQ ID NO: 3047 - protein, 123 aa, Artificial Sequence
  Description of Artificial Sequence: Synthetic heavy chain variable domain
QQQLEESGGGLVKPEGSLTLTCKASGFDLGFYFYACWVRQAPGKGLEWIACIYTAGSGSTYYASWAKGRFTISKASSTTVTLQMTSLAAADTATYFCARSTANTRSTYYLNLWGPGTLVTVSS

SEQ ID NO: 3048 - protein, 119 aa, Artificial Sequence
  Description of Artificial Sequence: Synthetic heavy chain variable domain
QEQLVESGGGLVQPGASLTLTCTASGIDFSRYYMCWVRQAPGKGLEGIACIYIGGSGSTYYASWAKGRFTISKASSTTVTLQMTSLTAADTATYFCARGTNLNYIFRLWGPGTLVTVSS

SEQ ID NO: 3049 - protein, 115 aa, Artificial Sequence
  Description of Artificial Sequence: Synthetic heavy chain variable domain
QSLEESGGDLVKPGASLTLTCKASGFDFSSNAMCWVRQAPGKGLEWIACIYVGDGNTYYASWAKGRFTISKTSSTTVTLQMTSLTAADTATYFCARGYASYGSDYYWDYFKLWGP

SEQ ID NO: 3050 - protein, 120 aa, Artificial Sequence
  Description of Artificial Sequence: Synthetic heavy chain variable domain
QSLEESGGDLVKPGASLTLTCTASGFSFSGDYYMCWVRQAPGKGLEWIACIGGGSNTATYYATWAKGRFTISKTSSTTVTLQMTSLTAADTATYFCARDLGFVDYALELWGPGTLVTVSS

SEQ ID NO: 3051 - protein, 123 aa, Artificial Sequence
  Description of Artificial Sequence: Synthetic heavy chain variable domain
QEQLEESGGDLVKPGASLTLTCTASGFSFSSSYWICWVRQAPGKGLEWIACIYAGDGGATYDASWVNGRFSISKTSSTTVTLQMTSLTAADTATYFCARKGAAPTTYYYFNLWGPGTLVTVSS

SEQ ID NO: 3052 - protein, 122 aa, Artificial Sequence
  Description of Artificial Sequence: Synthetic heavy chain variable domain
QEQLEESGGDLVQPEGSLTLTCKASGLDFSSSYWICWVRQAPGKGLEWIGCRHTFTANTWSASWVNGRFTISRSTSLGTVDLKMTSLTAADTATYFCARDESNNDGWDFKLWGPGTLVTVSS

SEQ ID NO: 3053 - protein, 118 aa, Artificial Sequence; identical to SEQ ID NO: 2486
  Description of Artificial Sequence: Synthetic heavy chain variable domain

SEQ ID NO: 3054 - protein, 236 aa, Artificial Sequence
  Description of Artificial Sequence: Synthetic heavy chain variable domain
EVQLEVQLVESGGGLVQPGESLKLSCESNEYEFPSHDMSWVRKTPEKRLELVAAINSDGGSTYYPDTMERRFIISRDNTKKTLYLQMSSLRSEDTALYYCVRLYYGNVMDYWGQGTSVTVSSVESGGGLVQPGESLKLSCESNEYEFPSHDMSWVRKTPEKRLELVAAINSDGGSTYYPDTMERRFIISRDNTKKTLYLQMSSLRSEDTALYYCVRLYYGNVMDYWGQGTSVTVSS

SEQ ID NO: 3055 - protein, 120 aa, Artificial Sequence; identical to SEQ ID NO: 2488
  Description of Artificial Sequence: Synthetic heavy chain variable domain

SEQ ID NO: 3056 - protein, 118 aa, Artificial Sequence
  Description of Artificial Sequence: Synthetic heavy chain variable domain
QVQLQQSGAELMKPGASVKISCKAIGFTFNYFWIEWVKQRPGHGLEWIGEILPGTGSTNYNEEFKGKAIFTADTSSNTAYMQLRSLTSEDSAVYYCVRYDYTSSMDYNGQGTSVIVSS

SEQ ID NO: 3057 - protein, 118 aa, Artificial Sequence
  Description of Artificial Sequence: Synthetic heavy chain variable domain
QITLKESGPGILQPSQTLSLTCSFSGFSLSTSGMGVSWIRQPSGKGLEWLSHIYWDDDKRYNPSLDSRLSISKDTSRNQVFLKITSVDTADTATYYCAPGVSSWFPYWGPGTLVTVSA

SEQ ID NO: 3058 - protein, 119 aa, Artificial Sequence; identical to SEQ ID NO: 2491
  Description of Artificial Sequence: Synthetic heavy chain variable domain

SEQ ID NO: 3059 - protein, 119 aa, Artificial Sequence
  Description of Artificial Sequence: Synthetic heavy chain variable domain
QVQLQQSGAELVRPGSSVKISCKTSGYAFSNFWMNWVKQRPGQGLEWIGQIYPGDGDTNYNGKFKGKATLTADKSSSTAYMQLSSLTSEASAVYFCARSYYRSAWFAYWGQGTLVSVSA

SEQ ID NO: 3060 - protein, 112 aa, Artificial Sequence
  Description of Artificial Sequence: Synthetic heavy chain variable domain
DVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIK

SEQ ID NO: 3061 - protein, 119 aa, Artificial Sequence [sequence omitted]

SEQ ID NO: 3062 - protein, 115 aa, Artificial Sequence
  Description of Artificial Sequence: Synthetic heavy chain variable domain
QVTLKESGPALVKPTQTLTLTCTFSGFSLSTSGMRVSWIRQPPGKALEWIARIDWDDDKYYSTSLKTRLTISKDTSKNQVVLTMTNMDPVDTATYYCARIYFDYWGQGTLVTVSS

SEQ ID NO: 3063 - protein, 115 aa, Artificial Sequence
  Description of Artificial Sequence: Synthetic heavy chain variable domain
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIYFDYWGQGTLVTVSS

SEQ ID NO: 3064 - protein, 115 aa, Artificial Sequence
  Description of Artificial Sequence: Synthetic heavy chain variable domain
QVTLKESGPTLVKPTQTLTLTCTFSGFSLSTSGVGVGWIRQPPGKALEWLALIYWDDDKRYGPSLKSRLTITKDTSKNQVVLTMTNMDPVDTATYYCAHRYFDYWGQGTLVTVSS

SEQ ID NO: 3065 - protein, 115 aa, Artificial Sequence
  Description of Artificial Sequence: Synthetic heavy chain variable domain
RVTLRESGPALVKPTQTLTLTCTFSGFSLSTSGMCVSWIRQPPGKALEWLARIDWDDDKYYSTSLKTRLTISKDTSKNQVVLTMTNMDPVDTATYYCARIYFDYWGQGTLVTVSS

SEQ ID NO: 3066 - protein, 118 aa, Artificial Sequence
  Description of Artificial Sequence: Synthetic heavy chain variable domain
QVTLKESGPALVKPTQTLTLTCTFSGFSLSTSGMGVSWIRQPPGKALEWIARIWWDDDKYYSTSLKTRLTISKDTSKNQVVLTMTNMDPVDTATYYCARIDWDGFAYWGQGTLVTVSS

SEQ ID NO: 3067 - protein, 118 aa, Artificial Sequence
  Description of Artificial Sequence: Synthetic heavy chain variable domain
QVTLKESGPALVKPTQTLTLTCSFSGFSLSTSGMGVGWIRQPPGKALEWIAHIWWDDDKYYNTALKTRLTISKDTSKNQVVLTMTNMDPVDTATYYCARIDWDGFAYWGQGTLVTVSS

SEQ ID NO: 3068 - protein, 118 aa, Artificial Sequence
  Description of Artificial Sequence: Synthetic heavy chain variable domain
QVTLKESGPALVKPTQTLTLTCSFSGFSLSTSGMGVGWIRQPPGKALEWLAHIWWDDDKYYNTALKTRLTISKDTSKNQVVLTMTNMDPVDTATYYCARIDWDGFAYWGQGTLVTVSS

SEQ ID NO: 3069 - protein, 118 aa, Artificial Sequence
  Description of Artificial Sequence: Synthetic heavy chain variable domain
QVTLKESGPGILQPSQTLSLTCSFSGFSLSTSGMGVGWIRQPSGKGLEWLAHIWWDDDKYYNTALKSGLTISKDTSKNQVFLKIASVDTTDTATYYCARIDWDGFAYWGQGTLVTVSS

SEQ ID NO: 3070 - protein, 118 aa, Artificial Sequence
  Description of Artificial Sequence: Synthetic heavy chain variable domain
QVTLKESGPALVKPTQTLTLTCSFSGFSLSTSGMGVSWIRQPPGKALEWIARIWWDDDKYYSTSLKTRLTISKDTSKNQVVLTMTNMDPVDTATYYCARIDWDGFAYWGQGTLVTVSS

SEQ ID NO: 3071 - protein, 118 aa, Artificial Sequence
  Description of Artificial Sequence: Synthetic heavy chain variable domain
QVTLKESGPALVKPTQTLTLTCTFSGFSLSTSGMGVSWIRQPPGKALEWIAHIWWDDDKYYSTSLKTRLTISKDTSKNQVVLTMTNMDPVDTATYYCARIDWDGFAYWGQGTLVTVSS

SEQ ID NO: 3072 - protein, 118 aa, Artificial Sequence
  Description of Artificial Sequence: Synthetic heavy chain variable domain
QVTLKESGPALVKPTQTLTLTCSFSGFSLSTSGMGVSWIRQPPGKALEWIAHIWWDDDKYYSTSLKTRLTISKDTSKNQVVLTMTNMDPVDTATYYCARIDWDGFAYWGQGTLVTVSS

SEQ ID NO: 3073 - protein, 118 aa, Artificial Sequence
  Description of Artificial Sequence: Synthetic heavy chain variable domain
QVTLKESGPALVKPTQTLTLTCSFSGFSLSTSGMGVSWIRQPPGKALEWIAHIWWDDDKYYNTALKTRLTISKDTSKNQVVLTMTNMDPVDTATYYCARIDWDGFAYWGQGTLVTVSS

SEQ ID NO: 3074 - protein, 454 aa, Artificial Sequence
  Description of Artificial Sequence: Synthetic heavy chain variable domain
QVQLQQSGPGLVKPSQTLSLTCAISGDSVSSNSAAWGWIRQSPGRGLEWLGRIYYRSKWYNSYAVSVKSRITINPDTSKNQFSLQLNSVTPEDTAVYYCARYDWVPKIGVFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3075 - protein, 447 aa, Artificial Sequence
  Description of Artificial Sequence: Synthetic heavy chain variable domain
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3076 - protein, 447 aa, Artificial Sequence
  Description of Artificial Sequence: Synthetic heavy chain variable domain
EVQLVQSGAEVKKPGESLRISCKGSGYTFTSYWMYWVRQARGQRLEWIGRIDPNSGSTKYNEKFKNRLTISKDTSKNQVVLTMTNMDPVDTATYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3077 - protein, 120 aa, Artificial Sequence; identical to SEQ ID NO: 2733
  Description of Artificial Sequence: Synthetic heavy chain variable domain

SEQ ID NO: 3078 - protein, 119 aa, Artificial Sequence; identical to SEQ ID NO: 2734
  Description of Artificial Sequence: Synthetic heavy chain variable domain

SEQ ID NO: 3079 - protein, 120 aa, Artificial Sequence; identical to SEQ ID NO: 2736
  Description of Artificial Sequence: Synthetic heavy chain variable domain

SEQ ID NO: 3080 - protein, 119 aa, Artificial Sequence; identical to SEQ ID NO: 2902
  Description of Artificial Sequence: Synthetic heavy chain variable domain

SEQ ID NO: 3081 - protein, 121 aa, Artificial Sequence; identical to SEQ ID NO: 2903
  Description of Artificial Sequence: Synthetic heavy chain variable domain

SEQ ID NO: 3082 - protein, 117 aa, Artificial Sequence; identical to SEQ ID NO: 2892
  Description of Artificial Sequence: Synthetic heavy chain variable domain

SEQ ID NO: 3083 - protein, 122 aa, Artificial Sequence; identical to SEQ ID NO: 2897
  Description of Artificial Sequence: Synthetic heavy chain variable domain

SEQ ID NO: 3084 - protein, 120 aa, Artificial Sequence; identical to SEQ ID NO: 2893
  Description of Artificial Sequence: Synthetic heavy chain variable domain

SEQ ID NO: 3085 - protein, 117 aa, Artificial Sequence; identical to SEQ ID NO: 2894
  Description of Artificial Sequence: Synthetic heavy chain variable domain

SEQ ID NO: 3086 - protein, 123 aa, Artificial Sequence; identical to SEQ ID NO: 2895
  Description of Artificial Sequence: Synthetic heavy chain variable domain

SEQ ID NO: 3087 - protein, 117 aa, Artificial Sequence; identical to SEQ ID NO: 2896
  Description of Artificial Sequence: Synthetic heavy chain variable domain

SEQ ID NO: 3088 - protein, 123 aa, Artificial Sequence; identical to SEQ ID NO: 2898
  Description of Artificial Sequence: Synthetic heavy chain variable domain

SEQ ID NO: 3089 - protein, 120 aa, Artificial Sequence
  Description of Artificial Sequence: Synthetic heavy chain variable domain
EVQLQQSGPELVKPGASVKISCKASGYSFTGYLMNWVMQSHGKSLEWIGRINPYNGDIFYNQKFKDKATLTVDKSSSTAHMELRSLASEDSAVYYCARRDENFDYDNAMDYWGQGTSVTL

SEQ ID NO: 3090 - protein, 121 aa, Artificial Sequence; identical to SEQ ID NO: 2900
  Description of Artificial Sequence: Synthetic heavy chain variable domain

SEQ ID NO: 3091 - protein, 118 aa, Artificial Sequence; identical to SEQ ID NO: 2901
  Description of Artificial Sequence: Synthetic heavy chain variable domain

SEQ ID NO: 3092 - protein, 119 aa, Artificial Sequence; identical to SEQ ID NO: 859
  Description of Artificial Sequence: Synthetic heavy chain variable domain

SEQ ID NO: 3093 - protein, 449 aa, Artificial Sequence
  Description of Artificial Sequence: Synthetic polypeptide
QVQLKESGPGLVAPSQSLSITCTVSGFSVTNYGVHWVRQPPGKGLEWLGVIWAGGITNYNSAFMSRLSISKDNSKSQVFLKMNSLQIDDTAMYYCASRGGHYGYALDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3094 - protein, 449 aa, Artificial Sequence; identical to SEQ ID NO: 3093
  Description of Artificial Sequence: Synthetic heavy chain variable domain

SEQ ID NO: 3095 - protein, 112 aa, Artificial Sequence
  Description of Artificial Sequence: Synthetic light chain variable domain
DIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKR

SEQ ID NO: 3096 - protein, 447 aa, Artificial Sequence
  Description of Artificial Sequence: Synthetic light chain variable domain
QVQLVQSGAEVKKPGASVKVSCKASGYTFTSYWMYWVRQATGQGLEWMGRIDPNSGSTKYNEKFKNRFTISRDDSKNTAYLQMNSLKTEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3097 - protein, 112 aa, Artificial Sequence; identical to SEQ ID NO: 3095
  Description of Artificial Sequence: Synthetic light chain variable domain

SEQ ID NO: 3098 - protein, 112 aa, Artificial Sequence
  Description of Artificial Sequence: Synthetic light chain variable domain
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLQIKR

SEQ ID NO: 3099 - protein, 106 aa, Artificial Sequence
  Description of Artificial Sequence: Synthetic light chain variable domain
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 3100 - protein, 106 aa, Artificial Sequence
  Description of Artificial Sequence: Synthetic light chain variable domain
EIVLTQSPSSLSASVGDRVTITCSARSSVSYMHWYQQKPGKAPKLWIYRTSNLASGVPSRFSGSGSGTDFTLTINSLQPEDFATYYCQQRSSFPLTFGGGTKLEIK

SEQ ID NO: 3101 - protein, 106 aa, Artificial Sequence
  Description of Artificial Sequence: Synthetic light chain variable domain
EIVLTQSPSSLSASVGDRVTITCSARSSVSYMHWFQQKPGKAPKLWIYRTSNLASGVPSRFSGSGSGTDYTLTINSLQPEDFATYYCQQRSSFPLTFGGGTKLEIK

SEQ ID NO: 3102 - protein, 107 aa, Artificial Sequence
  Description of Artificial Sequence: Synthetic light chain variable domain
EIVLTQSPSSLSASVGDRVTITCSARSSVSYMHWFQQKPGKAPKLWIYRTSNLASGVPSRFSGSGSGTDYCLTINSLQPEDFATYYCQQRSSSFPLTFGGGTKLEIK

SEQ ID NO: 3103 - protein, 131 aa, Artificial Sequence
  Description of Artificial Sequence: Synthetic light chain variable domain
MKLPVRLLVLMFWIPASNSDVVMTQTPLSLPVSLGDQASISCRSSQNLVHSDGNTYLHWYLQKPGQSPKLLIYKVSNRFSGVPDRFSGSGSGTDFTLKISRVEAEDLGVYFCSQSTHVPYTFGGGTKLEIK

SEQ ID NO: 3104 - protein, 131 aa, Artificial Sequence
  Description of Artificial Sequence: Synthetic light chain variable domain
MKLPVRLLVLMFWIPASSSDVVMTQTPLSLPVSLGDQASISCRSSQSLVHSNGNIYLHWFLQKPGQSPKLLIYKVSNRFSGVPDRFSGSGSGTDFTLKISRVEAEDLGVYFCSQSTHVPLTFGAGTKLELK

SEQ ID NO: 3105 - protein, 111 aa, Artificial Sequence
  Description of Artificial Sequence: Synthetic light chain variable domain
EIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYFFGQGTKLEIKR

SEQ ID NO: 3106 - protein, 111 aa, Artificial Sequence
  Description of Artificial Sequence: Synthetic light chain variable domain
EIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKR

SEQ ID NO: 3107 - protein, 112 aa, Artificial Sequence
  Description of Artificial Sequence: Synthetic light chain variable domain
EIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKR

SEQ ID NO: 3108 - protein, 107 aa, Artificial Sequence
  Description of Artificial Sequence: Synthetic light chain variable domain
EIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKR

SEQ ID NO: 3109 - protein, 112 aa, Artificial Sequence
  Description of Artificial Sequence: Synthetic light chain variable domain
GIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIK

SEQ ID NO: 3110 - protein, 111 aa, Artificial Sequence
  Description of Artificial Sequence: Synthetic light chain variable domain
DVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIK

SEQ ID NO: 3111 - protein, 112 aa, Artificial Sequence
  Description of Artificial Sequence: Synthetic light chain variable domain
DIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIK

SEQ ID NO: 3112 - protein, 107 aa, Artificial Sequence
  Description of Artificial Sequence: Synthetic light chain variable domain
DVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEIN

SEQ ID NO: 3113 - protein, 113 aa, Artificial Sequence
  Description of Artificial Sequence: Synthetic light chain variable domain
QSALTQPASVSGSPGQSITISCTATGSDVGVYYYVSWYQQHPGKAPKVMIYDVGNRPPGVSNRFSGSKSGNTASLTISGLQAEDEADYYCASYTNRNSLGYVFGTGTKVTVLG

SEQ ID NO: 3114 - protein, 111 aa, Artificial Sequence
  Description of Artificial Sequence: Synthetic light chain variable domain
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSTVVFGGGTKLTVLG

SEQ ID NO: 3115 - protein, 109 aa, Artificial Sequence
  Description of Artificial Sequence: Synthetic light chain variable domain
SYELTQPPSVSVAPGKTARITCGGDNIGTKSVTWYQQRPGQAPMMVIYYDTVRPSGIPERLSGSNSGNTATLTITRVEAGDEADYYCQVWDSSSDHPVFGGGTKLTVLG

SEQ ID NO: 3116 - protein, 109 aa, Artificial Sequence
  Description of Artificial Sequence: Synthetic light chain variable domain
QSVLTQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKLTVLG

SEQ ID NO: 3117 - protein, 110 aa, Artificial Sequence
  Description of Artificial Sequence: Synthetic light chain variable domain
QAVVTQEPSLTVSPGGTVTLTCGSSTGAVTSGHYPYWFQQKPGQAPRTLIYDASDKHSWTPARFSGSLLGGKAALTLSGAQPEDEAEYYCLLSYSDALVFGGGTKLTVLG

SEQ ID NO: 3118 - protein, 111 aa, Artificial Sequence
  Description of Artificial Sequence: Synthetic light chain variable domain
QSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLG

SEQ ID NO: 3119 - protein, 111 aa, Artificial Sequence
  Description of Artificial Sequence: Synthetic light chain variable domain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLG

SEQ ID NO: 3120 - protein, 113 aa, Artificial Sequence
  Description of Artificial Sequence: Synthetic light chain variable domain
QSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLG

SEQ ID NO: 3121 - protein, 113 aa, Artificial Sequence
  Description of Artificial Sequence: Synthetic light chain variable domain
QSALTQPASVSGSPGQSITISCTATGSDVGVYYYVSWYQQHPGKAPKVMIYDVDNRPPGVSNRFSGSKSGNTASLTISGLQAEDEADYYCASYTNRNSLGYVFGTGTKVTVLG

SEQ ID NO: 3122 - protein, 108 aa, Artificial Sequence
  Description of Artificial Sequence: Synthetic light chain variable domain
QPGLTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVL

SEQ ID NO: 3123 - protein, 110 aa, Artificial Sequence
  Description of Artificial Sequence: Synthetic light chain variable domain
QPGLTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLGQ

SEQ ID NO: 3124 - protein, 96 aa, Artificial Sequence
  Description of Artificial Sequence: Synthetic light chain variable domain
TLVGDRVNITCKASQDVSTAVAWYQQKPGLSPKLLIYWASTRHTGVPDRFTGSGSGTDYILTISSVQAEDLALYVCQQHYSTPFTFGSGTKLEIKR

SEQ ID NO: 3125 - protein, 108 aa, Artificial Sequence
  Description of Artificial Sequence: Synthetic light chain variable domain
DIVLTQSPATLSVTPGDSVSLSCRASQSVSNNLHWYQQKSHASPRLLIKYASQSISGIPSRFSGSGSGTDFTLSINSVETEDFGMVFCQQSYSWPRTFGGGTKLEIKR

SEQ ID NO: 3126 - protein, 112 aa, Artificial Sequence
  Description of Artificial Sequence: Synthetic light chain variable domain
DIVLTQSPASLAVSLGQRATISCRASESVDRYGNSFMHWYQQKPGQPPKLLIYRASNLESGIPARFSGSGSRTDFTLTINPVEADDVATYYCQQSNEVPDTFGGGTKLEIKR

SEQ ID NO: 3127 - protein, 108 aa, Artificial Sequence
  Description of Artificial Sequence: Synthetic light chain variable domain
DIVMTQSQKFMSTSVGDRVSITCKASQNVRTVVAWYQQKPGQSPKALIYLASNRHTGVPDRFTGSGSGTDFTLTISNVQSEDLADYFCLQHWNYPVTFGGGTKLEIKR

SEQ ID NO: 3128 - protein, 107 aa, Artificial Sequence
  Description of Artificial Sequence: Synthetic light chain variable domain
SIVMTQTPKFLLVSAGDRVTITCKASQSVSNAVAWYQQKPGQSPTMVIVHASNRYTGVPDRHGSGYGTDFTFTISSVQAEDLAVYFCQQDYSSPLTFGAGTKLELKR

SEQ ID NO: 3129 - protein, 107 aa, Artificial Sequence
  Description of Artificial Sequence: Synthetic light chain variable domain
DIQMTQTTSSLSASLGDRVTISCRASQGISNYLNWYQQKPDGTVKLLIYYTSSLHSGVPSRFSGSGSGTDFSLTISNLEPEDFATYYCQQYTKLPYTFGGGTKLEIR

SEQ ID NO: 3130 - protein, 106 aa, Artificial Sequence
  Description of Artificial Sequence: Synthetic light chain variable domain
ENVLTQSPAIMSASLGEKVTMSCRASSSVNYMYWYQQKSDASPKLWIVYTSNLAPGVPARFSGSGSGDSYSLTISSMEGEDAATYVCQQLTSSPYTFGGGTKLEIR

SEQ ID NO: 3131 - protein, 108 aa, Artificial Sequence
  Description of Artificial Sequence: Synthetic light chain variable domain
DTVMTQSQKFMSTTVGDRVSITCKASQNVGTAVAWYQQKPGQSPKLLIYLASNRYTGVPDRFTGSGSGTDFTLTISNMQSEDLADYFCQQYNSYPLTFGGGTKLEIKR

SEQ ID NO: 3132 - protein, 108 aa, Artificial Sequence
  Description of Artificial Sequence: Synthetic light chain variable domain
DIQMTQSSSYLSLSLGGRVTITCKASDHINNWLAWYQQKPGTAPRLLISGATSLETGVPSRFSGSGSGKDFTLSITSLQAEDVATYYCQQYWSTPYTFGGGTKLEIKR

SEQ ID NO: 3133 - protein, 111 aa, Artificial Sequence
  Description of Artificial Sequence: Synthetic light chain variable domain
DIVLTQSPASLAVSLGQRATISCRASESVDRDGNSLMNWYQQKPGQPPKLLIYRAFNLESGIPARFSGSGSRTDFTLTITPVEADDVATYYCQQSNEAPYTFGGGTKLQIK

SEQ ID NO: 3134 - protein, 107 aa, Artificial Sequence
  Description of Artificial Sequence: Synthetic light chain variable domain
DIQMTQSSSYLSLSLGGRVTITCKASDHINNWLAWYQQKPGTAPRLLISGATSLETGVPSRFSGSGSGKDHLSITSLQAEDVATYYCQQYWSTPYTFGGGTKLEIKR

SEQ ID NO: 3135 - protein, 107 aa, Artificial Sequence
  Description of Artificial Sequence: Synthetic light chain variable domain
DIVMTQSQKFMSTSVGDRVSITCKASQNVGNNVAWYQQKPGQSPKLLIYSASNRDSGVPDRFSGSGSGTDFTLTISNMQSEDLADYFCQQYNIYPFTFGGGTKLEIK

SEQ ID NO: 3136 - protein, 107 aa, Artificial Sequence
  Description of Artificial Sequence: Synthetic light chain variable domain
DIVMTQSQKFMPTSVGDRVSVTCKASQNVGNNVAWYQQKPGQSPKALIYSASNRDSGVPDRFTGSGSGTDFTLTITNVQSEDLAEYFCQQYNIYPFTFGAGTKLELK

SEQ ID NO: 3137 - protein, 107 aa, Artificial Sequence; identical to SEQ ID NO: 3135
  Description of Artificial Sequence: Synthetic light chain variable domain

SEQ ID NO: 3138 - protein, 107 aa, Artificial Sequence; identical to SEQ ID NO: 3136
  Description of Artificial Sequence: Synthetic light chain variable domain

SEQ ID NO: 3139 - protein, 107 aa, Artificial Sequence
  Description of Artificial Sequence: Synthetic light chain variable domain
EIVLTQSPSTQSASVGDRVTITCKASQNVGNNVAWYQQKPGKAPKLLIYSASNRDSGVPSRFSGSGSGTEFTLTISSLQPDDFATYYCQQYNIYPFTFGQGTKLEIK

SEQ ID NO: 3140 - protein, 107 aa, Artificial Sequence
  Description of Artificial Sequence: Synthetic light chain variable domain
DIVMTQSPSTLSASVGDRVTITCKASQNVGNNVAWYQQKPGKAPKLLIYSASNRDSGVPSRFSGSGSGTEFTLTISSLQPDDFATYYCQQYNIYPFTFGQGTKLEIK

SEQ ID NO: 3141 - protein, 107 aa, Artificial Sequence
  Description of Artificial Sequence: Synthetic light chain variable domain
DILMTQSQKIMPTSVGDRVSVTCKASQNVGNNVAWYQQKPGQSPKALIYSASNRDSGVPDRFTGSGSGTDFTLTITNVQSEDLAEYFCQQYNIYPFTFGAGTKLDLK

SEQ ID NO: 3142 - protein, 107 aa, Artificial Sequence
  Description of Artificial Sequence: Synthetic light chain variable domain
DIVMTQSPSTLSASVGDRVTITCKASQNVGNNVAWYQQKPGKAPKLLISSASNRDSGVPSRFSGSGSGTEFTLTISSLQPDDFATYFCQQYNIYPFTFGQGTKLEIK

SEQ ID NO: 3143 - protein, 107 aa, Artificial Sequence
  Description of Artificial Sequence: Synthetic light chain variable domain
DIVMTQSQKFKSTSVGDRVSVTCKASQNVGNNVAWYQQKAGQSPKALISSASNRDSGVPDRFTGSGSGTDFTLTISNVQSEDLADYFCQQYNIYPFTFGSGTKLEIK

SEQ ID NO: 3144 - protein, 214 aa, Artificial Sequence
  Description of Artificial Sequence: Synthetic light chain variable domain
DIVMTQSPSTLSASVGDRVTITCKASQNVGNNVAWYQQKPGKAPKLLISSASNRDSGVPSRFSGSGSGTEFTLTISSLQPDDFATYFCQQYNIYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3145 - protein, 112 aa, Artificial Sequence
  Description of Artificial Sequence: Synthetic light chain variable domain
DVLMTQTPLSLPVSLGDQASISCRSSQSLVHSNGIPYLHWYLQKPGQSPKLLIYRVSNRFSGVPDRFSGSGSGTDFTLKISRVEAEDLGVYFCSQGTHVPPTFGGGTKLEIK

SEQ ID NO: 3146 - protein, 112 aa, Artificial Sequence
  Description of Artificial Sequence: Synthetic light chain variable domain
DIVMTQAAPSGPVTPGESVSISCRSSKSLLHSNGNTYLYWFLQRPGQSPQLLIYRMSNLASGVPDRFSGSGSGTAFTLRISRVEAEDVGIYYCMQHREYPFTFGGGTKLEIK

SEQ ID NO: 3147 - protein, 110 aa, Artificial Sequence
  Description of Artificial Sequence: Synthetic light chain variable domain
DIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRAD

SEQ ID NO: 3148 - protein, 108 aa, Artificial Sequence
  Description of Artificial Sequence: Synthetic light chain variable domain
EIVLTQSPGTLSLSPGERATLSCRASQSVSSNYLAWFQQKPGQAPRLLIFGTSSRATGIPDRFSGSGSGTDFTLTISRLEPEDFAVYYCQQYGSSIFTFGPGTKVDIK

SEQ ID NO: 3149 - protein, 107 aa, Artificial Sequence
  Description of Artificial Sequence: Synthetic light chain variable domain
DIQMTQSPSSVSASVGDRVTITCRASQGIRSWLAWYQQKPGKAPKLLIYAISRLQSGVPSRFSGSGSGTDFTLTISSLQPEDFATYYCQQANSFPLTFGGGTKVEIK

SEQ ID NO: 3150 - protein, 107 aa, Artificial Sequence
  Description of Artificial Sequence: Synthetic light chain variable domain
DIQMTQSPSSVSASVGDRVTITCRASQGISSWLAWYQQKSGKAPKLLIYAASGLQSGVPSRFSGSGSGTDFTLTISSLQPEDLATYYCQQSHSLPPTFGQGTKVEIK

SEQ ID NO: 3151 - protein, 108 aa, Artificial Sequence
  Description of Artificial Sequence: Synthetic light chain variable domain
SYVLTQPPSVSVAPGQTARITCGGNNIGSKSVHWYQQKPGQAPVLVVYDDSDRPSGIPERFSGSNSGNTATLTISRVEAGDEADYYCQVWDSSNDHVVFGGGTKLTVL

SEQ ID NO: 3152 - protein, 108 aa, Artificial Sequence
  Description of Artificial Sequence: Synthetic light chain variable domain
SYELTQPPSVSVSPGQAARITCSGDALPQKYVFWYQQKSGQAPVLVIYEDSKRPSGIPERFSGSSSGTMATLTISGAQVEDEADYYCYSTDRSGNHRVFGGGTRLTVL

SEQ ID NO: 3153 - protein, 108 aa, Artificial Sequence
  Description of Artificial Sequence: Synthetic light chain variable domain
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 3154 - protein, 108 aa, Artificial Sequence
  Description of Artificial Sequence: Synthetic light chain variable domain
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTEVEIK

SEQ ID NO: 3155 - protein, 108 aa, Artificial Sequence
  Description of Artificial Sequence: Synthetic light chain variable domain
SYELTQPPSVSVSPGQTARITCSGDALPQKYVFWYQQKSGQAPVLVIYEDSKRPSGIPERFSGSSSGTMATLTISGAQVEDEADYYCYSTDRSGNHRVFGGGTKLTVL

SEQ ID NO: 3156 - protein, 214 aa, Artificial Sequence
  Description of Artificial Sequence: Synthetic light chain variable domain
DIVMTQSPATLSVTPGDRVSLSCRASQSISDYLHWYQQKSHESPRLLIKYASQSISGIPSRFSGSGSGSDFTLSINSVEPEDVGVYYCQNGHSFPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3157 - protein, 214 aa, Artificial Sequence
  Description of Artificial Sequence: Synthetic light chain variable domain
EIVMTQSPATLSVSPGERVTLSCRASQSISDYLHWYQQKPGQAPRLLIKYASQSISGIPARFSGSGSGTEFTLTISSVQPEDVGVYYCQNGHSFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3158 - protein, 214 aa, Artificial Sequence
  Description of Artificial Sequence: Synthetic light chain variable domain
EIVMTQSPATLSVSPGERVTLSCRASQSISDYLHWYQQKSHESPRLLIKYASQSISGIPARFSGSGSGTEFTLTINSVEPEDVGVYYCQNGHSFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3159 - protein, 214 aa, Artificial Sequence
  Description of Artificial Sequence: Synthetic light chain variable domain
EIVMTQSPATLSVSPGERVSLSCRASQSISDYLHWYQQKSHESPRLLIKYASQSISGIPARFSGSGSGSEFTLTINSVEPEDVGVYYCQNGHSFPLTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3160 - protein, 214 aa, Artificial Sequence
  Description of Artificial Sequence: Synthetic light chain variable domain
EIVMTQSPATLSVSPGERVTLSCRASQSISDYLYWYQQKSHESPRLLIKYASQSISGIPARFSGSGSGSEFTLTINSVEPEDVGVYYCQNGHSFPLTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3161 - protein, 214 aa, Artificial Sequence
  Description of Artificial Sequence: Synthetic light chain variable domain
EIVMTQSPATLSVSPGERVTLSCRASQSISDYLHWYQQKSHQAPRLLIKYASQSISGIPARFSGSGSGSEFTLTISSLQPEDFGVYYCQNGHSFPLTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3162 - protein, 214 aa, Artificial Sequence
  Description of Artificial Sequence: Synthetic light chain variable domain
EIVMTQSPATLSVSPGERVTLSCRASQSISDYLYWYQQKSHQAPRLLIKYASQSISGIPARFSGSGSGSEFTLTISSLQPEDFGVYYCQNGHSFPLTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3163 - protein, 214 aa, Artificial Sequence
  Description of Artificial Sequence: Synthetic light chain variable domain
DIVMTQSPATLSVTPGDRVTLSCRASQSISDYLYWYQQKSHESPRLLIKYASQSISGIPSRFSGSGSGSDFTLSINSVEPEDVGVYYCQNGHSFPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3164 - protein, 109 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIK

SEQ ID NO: 3165 - protein, 109 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPRITFGQGTRLEIK

SEQ ID NO: 3166 - protein, 109 aa, Artificial Sequence
  Description of Artificial Sequence: Synthetic light chain variable domain
EIVLTQSPATLSLSPGERATLSCRASQSVSSNLAWYQQKPGQAPRLLIYDTSTRATGIPARFSGSGSGTEFTLTISSLQSEDFAVYYCQQYNNWPPAYTFGQGTKLEIK

SEQ ID NO: 3167 - protein, 106 aa, Artificial Sequence
  Description of Artificial Sequence: Synthetic light chain variable domain
DIQMTQSPSSLSASVGDRVTITCSATSSISYMHWYQQKPGKAPKGWIYDTSKLAHGVPSRFSGSGSGTDYTLTISSLQPEDFATYYCHQRRSYPFTFGQGTKVEIK

SEQ ID NO: 3168 - protein, 113 aa, Artificial Sequence
  Description of Artificial Sequence: Synthetic light chain variable domain
DIVMTQSPSSLIVTAGEKVTMSCRSSQSLFDSGSQRNYLTWFHQKPGRPPKLLIYWASTRESGVPDRFTGSGSGTDFTLTISSVQTEDLAVYFCQNDYSFPFTFGSGTKLEEK

SEQ ID NO: 3169 - protein, 108 aa, Artificial Sequence
  Description of Artificial Sequence: Synthetic light chain variable domain
DIQMTQSPSSLSASVGDRVTITCKASQGFNKYVAWYQQKPGKAPKLLIYYTSTLQPGVPSRFSGSGSGRDYTLTISSLQPEDFATYYCLQYGDLLYAFGQGTKVEIKR

SEQ ID NO: 3170 - protein, 214 aa, Artificial Sequence
  Description of Artificial Sequence: Synthetic light chain variable domain
DIQMTQSPSSLSASVGDRVTITCKASQGFNKYVAWYQQKPGKAPKLLIYYTSTLQPGVPSRFSGSGSGRDYTLTISSLQPEDFATYYCLQYGDLLYAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3171 - protein, 213 aa, Artificial Sequence
  Description of Artificial Sequence: Synthetic light chain variable domain
DIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3172 - protein, 107 aa, Artificial Sequence
  Description of Artificial Sequence: Synthetic light chain variable domain
QAVVTQESALTTSPGDTVTLTCRSSTGAVTTSNYANWVQEKPDHLFTGLIGGTNNRVPGVPARFSGSLIGDKAALTITGAQTEDEAMYFCALWYNNHWVFGGGTKLE

SEQ ID NO: 3173 - protein, 106 aa, Artificial Sequence
  Description of Artificial Sequence: Synthetic light chain variable domain
QIVLTQSPTIMSASPGEKVTLTCSATSSISYMHWYQQKPGTSPKGWIYDTSKLAHGVPARFSGSGSGTSYSLTISSMEAEDAATYYCHQRRSYPFTFGSGTKLEIK

SEQ ID NO: 3174 - protein, 108 aa, Artificial Sequence
  Description of Artificial Sequence: Synthetic light chain variable domain
DIQMTQSPSSLSASLGGKVTITCKASQGFNKYVAWYQHKPGQCPRLLIHYTSTLQPGIPARFSGSGSGRDYSFSISNLEPEDSATYFCLQYGNLLYAFGGGTKLEIKR

SEQ ID NO: 3175 - protein, 108 aa, Artificial Sequence
  Description of Artificial Sequence: Synthetic light chain variable domain
DIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKR

SEQ ID NO: 3176 - protein, 106 aa, Artificial Sequence
  Description of Artificial Sequence: Synthetic light chain variable domain
DIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIK

SEQ ID NO: 3177 - protein, 108 aa, Artificial Sequence
  Description of Artificial Sequence: Synthetic light chain variable domain
DIQMTQSPSSLSASVGDRVTITCKASQGFNKYVAWYQQKPGKAPKLLIHYTSTLQPGVPSRFSGSGSGRDYTLTISSLQPEDFATYYCLQYGNLLYAFGQGTKVEIKR

SEQ ID NO: 3178 - protein, 108 aa, Artificial Sequence
  Description of Artificial Sequence: Synthetic light chain variable domain
DIQMTQSPSSLSASVGDRVTITCKASQGFNKYVAWYQQKPGKAPKLLIHYTSTLQPGVPSRFSGSGSGTDYTLTISSLQPEDFATYYCLQYGNLLYAFGQGTKVEIKR

SEQ ID NO: 3179 - protein, 108 aa, Artificial Sequence
  Description of Artificial Sequence: Synthetic light chain variable domain
DIQMTQSPSSLSASVGDRVTITCKASQGFNKYVAWYQQKPGKAPKLLIHYTSTLQPGVPSRFSGSGSGTDFTLTISSLQPEDFATYYCLQYGNLLYAFGQGTKVEIKR

SEQ ID NO: 3180 - protein, 108 aa, Artificial Sequence
  Description of Artificial Sequence: Synthetic light chain variable domain
DIQMTQSPSSLSASVGDRVTITCKASQGFNKYVAWYQQKPGKAPKLLIHYTSTLQPGIPSRFSGSGSGRDYTLTISSLQPEDFATYYCLQYGNLLYAFGQGTKVEIKR

SEQ ID NO: 3181 - protein, 214 aa, Artificial Sequence
  Description of Artificial Sequence: Synthetic light chain variable domain
DIQMTQSPSSLSASVGDRVTITCKASQGFNKYVAWYQQKPGKAPKLLIYYTSTLQPGVPSRFSGSGSGRDYTLTISSLQPEDFATYYCLQYGDLLYAFGQGTKVEIKRTVAAPSVFIFPPSDEQLKSGTASVVCLLNNFYPREAKVQWCVDNALQSGNSQESVTEQDSKDSTYSLSSTLTLSKADYEKHKVYACEVTHQGLSSPVTKSFNRGEC

SEQ ID NO: 3182 - protein, 214 aa, Artificial Sequence
  Description of Artificial Sequence: Synthetic light chain variable domain
DIQMTQSPSSLSASVGDRVTITCKASQGFNKYVAWYQQKPGKAPKLLIYYTSTLQPGVPSRFSGSGSGRDYTLTISSLQPEDFATYYCLQYGDLLYAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPCTKSFNRGEC

SEQ ID NO: 3183 - protein, 213 aa, Artificial Sequence
  Description of Artificial Sequence: Synthetic light chain variable domain
DIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKRTVAAPSVFIFPPSDEQLKSGTASVVCLLNNFYPREAKVQWCVDNALQSGNSQESVTEQDSKDSTYSLSSTLTLSKADYEKHKVYACEVTHQGLSSPVTKSFNRGEC

SEQ ID NO: 3184 - protein, 213 aa, Artificial Sequence
  Description of Artificial Sequence: Synthetic light chain variable domain
DIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPCTKSFNRGEC

SEQ ID NO: 3185 - protein, 112 aa, Artificial Sequence
  Description of Artificial Sequence: Synthetic light chain variable domain
DIVITQTPLSLPVSLGDQASISCRSSQSIVHRNGNTYLEWYLQQPGQSPKLLIYKVSNRFSGVPDRFSGSGSGTDFTLKISRVEAEDLGVYYCFQGSYVPPTFGGGTKLEIK

SEQ ID NO: 3186 - protein, 112 aa, Artificial Sequence
  Description of Artificial Sequence: Synthetic light chain variable domain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGAGTKLELK

SEQ ID NO: 3187 - protein, 107 aa, Artificial Sequence
  Description of Artificial Sequence: Synthetic light chain variable domain
DIQMTQSPASLSASVGETVTITCRASENIGSYLAWYQQKQGKSPQLLVYAATLLADGVPSRFSGSGSGTQFSLKINSLQSEDVARYYCQHYYSTLVTFGAGTKLELK

SEQ ID NO: 3188 - protein, 214 aa, Artificial Sequence
  Description of Artificial Sequence: Synthetic light chain variable domain
DIQMTQSPSSLSASVGDRVTITCRANQGISNNLNWYQQKPGKAPKPLIYYTSNLQSGVPSRFSGSGSGTDYTLTISSLQPEDFATYYCQQFTSLPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3189 - protein, 116 aa, Artificial Sequence
  Description of Artificial Sequence: Synthetic light chain variable domain
DIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDP

SEQ ID NO: 3190 - protein, 109 aa, Artificial Sequence
  Description of Artificial Sequence: Synthetic light chain variable domain
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 3191 - protein, 112 aa, Artificial Sequence
  Description of Artificial Sequence: Synthetic light chain variable domain
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 3192 - protein, 111 aa, Artificial Sequence
  Description of Artificial Sequence: Synthetic light chain variable domain
DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 3193 - protein, 112 aa, Artificial Sequence
  Description of Artificial Sequence: Synthetic light chain variable domain
DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 3194 - protein, 106 aa, Artificial Sequence
  Description of Artificial Sequence: Synthetic light chain variable domain
DIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 3195 - protein, 112 aa, Artificial Sequence
  Description of Artificial Sequence: Synthetic light chain variable domain
EIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 3196 - protein, 106 aa, Artificial Sequence
  Description of Artificial Sequence: Synthetic light chain variable domain
EIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 3197 - protein, 107 aa, Artificial Sequence
  Description of Artificial Sequence: Synthetic light chain variable domain
EIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 3198 - protein, 109 aa, Artificial Sequence
  Description of Artificial Sequence: Synthetic light chain variable domain
EIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 3199 - protein, 105 aa, Artificial Sequence
  Description of Artificial Sequence: Synthetic light chain variable domain
DIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 3200 - protein, 107 aa, Artificial Sequence
  Description of Artificial Sequence: Synthetic light chain variable domain
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 3201 - protein, 112 aa, Artificial Sequence
  Description of Artificial Sequence: Synthetic light chain variable domain
DIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 3202 - protein, 107 aa, Artificial Sequence
  Description of Artificial Sequence: Synthetic light chain variable domain
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 3203 - protein, 108 aa, Artificial Sequence
  Description of Artificial Sequence: Synthetic light chain variable domain
ETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 3204 - protein, 109 aa, Artificial Sequence
  Description of Artificial Sequence: Synthetic light chain variable domain
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 3205 - protein, 107 aa, Artificial Sequence
  Description of Artificial Sequence: Synthetic light chain variable domain
ETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 3206 - protein, 107 aa, Artificial Sequence
  Description of Artificial Sequence: Synthetic light chain variable domain
DIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 3207 - protein, 112 aa, Artificial Sequence
  Description of Artificial Sequence: Synthetic light chain variable domain
EIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 3208 - protein, 108 aa, Artificial Sequence
  Description of Artificial Sequence: Synthetic light chain variable domain
SYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 3209 - protein, 106 aa, Artificial Sequence
  Description of Artificial Sequence: Synthetic light chain variable domain
SYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 3210 - protein, 107 aa, Artificial Sequence
  Description of Artificial Sequence: Synthetic light chain variable domain
DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 3211 - protein, 109 aa, Artificial Sequence
  Description of Artificial Sequence: Synthetic light chain variable domain
SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 3212 - protein, 108 aa, Artificial Sequence
  Description of Artificial Sequence: Synthetic light chain variable domain
SSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 3213 - protein, 113 aa, Artificial Sequence
  Description of Artificial Sequence: Synthetic light chain variable domain
EIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 3214 - protein, 108 aa, Artificial Sequence
  Description of Artificial Sequence: Synthetic light chain variable domain
EIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 3215 - protein, 109 aa, Artificial Sequence
  Description of Artificial Sequence: Synthetic light chain variable domain
EIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 3216 - protein, 109 aa, Artificial Sequence
  Description of Artificial Sequence: Synthetic light chain variable domain
EIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 3217 - protein, 107 aa, Artificial Sequence
  Description of Artificial Sequence: Synthetic light chain variable domain
DIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 3218 - protein, 109 aa, Artificial Sequence
  Description of Artificial Sequence: Synthetic light chain variable domain
EIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 3219 - protein, 109 aa, Artificial Sequence
  Description of Artificial Sequence: Synthetic light chain variable domain
EIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 3220 - protein, 109 aa, Artificial Sequence
  Description of Artificial Sequence: Synthetic light chain variable domain
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 3221 - protein, 109 aa, Artificial Sequence
  Description of Artificial Sequence: Synthetic light chain variable domain
EIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 3222 - protein, 109 aa, Artificial Sequence
  Description of Artificial Sequence: Synthetic light chain variable domain
EIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 3223 - protein, 112 aa, Artificial Sequence
  Description of Artificial Sequence: Synthetic light chain variable domain
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 3224 - protein, 110 aa, Artificial Sequence
  Description of Artificial Sequence: Synthetic light chain variable domain
EIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 3225 - protein, 109 aa, Artificial Sequence
  Description of Artificial Sequence: Synthetic light chain variable domain
EIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 3226 - protein, 107 aa, Artificial Sequence; identical to SEQ ID NO: 3205
  Description of Artificial Sequence: Synthetic light chain variable domain

SEQ ID NO: 3227 - protein, 107 aa, Artificial Sequence; identical to SEQ ID NO: 3206
  Description of Artificial Sequence: Synthetic light chain variable domain

SEQ ID NO: 3228 - protein, 112 aa, Artificial Sequence; identical to SEQ ID NO: 3207
  Description of Artificial Sequence: Synthetic light chain variable domain

SEQ ID NO: 3229 - protein, 108 aa, Artificial Sequence; identical to SEQ ID NO: 3208
  Description of Artificial Sequence: Synthetic light chain variable domain

SEQ ID NO: 3230 - protein, 106 aa, Artificial Sequence; identical to SEQ ID NO: 3209
  Description of Artificial Sequence: Synthetic light chain variable domain

SEQ ID NO: 3231 - protein, 107 aa, Artificial Sequence; identical to SEQ ID NO: 3210
  Description of Artificial Sequence: Synthetic light chain variable domain

SEQ ID NO: 3232 - protein, 109 aa, Artificial Sequence; identical to SEQ ID NO: 3211
  Description of Artificial Sequence: Synthetic light chain variable domain

SEQ ID NO: 3233 - protein, 108 aa, Artificial Sequence; identical to SEQ ID NO: 3212
  Description of Artificial Sequence: Synthetic light chain variable domain

SEQ ID NO: 3234 - protein, 113 aa, Artificial Sequence; identical to SEQ ID NO: 3213
  Description of Artificial Sequence: Synthetic light chain variable domain

SEQ ID NO: 3235 - protein, 108 aa, Artificial Sequence; identical to SEQ ID NO: 3214
  Description of Artificial Sequence: Synthetic light chain variable domain

SEQ ID NO: 3236 - protein, 107 aa, Artificial Sequence; identical to SEQ ID NO: 3217
  Description of Artificial Sequence: Synthetic light chain variable domain

SEQ ID NO: 3237 - protein, 109 aa, Artificial Sequence; identical to SEQ ID NO: 3218
  Description of Artificial Sequence: Synthetic light chain variable domain

SEQ ID NO: 3238 - protein, 109 aa, Artificial Sequence; identical to SEQ ID NO: 3220
  Description of Artificial Sequence: Synthetic light chain variable domain

SEQ ID NO: 3239 - protein, 109 aa, Artificial Sequence; identical to SEQ ID NO: 3221
  Description of Artificial Sequence: Synthetic light chain variable domain

SEQ ID NO: 3240 - protein, 110 aa, Artificial Sequence; identical to SEQ ID NO: 3224
  Description of Artificial Sequence: Synthetic light chain variable domain

SEQ ID NO: 3241 - protein, 107 aa, Artificial Sequence
  Description of Artificial Sequence: Synthetic light chain variable domain
DVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 3242 - protein, 111 aa, Artificial Sequence
  Description of Artificial Sequence: Synthetic light chain variable domain
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIK

SEQ ID NO: 3243 - protein, 109 aa, Artificial Sequence; identical to SEQ ID NO: 3190
  Description of Artificial Sequence: Synthetic light chain variable domain

SEQ ID NO: 3244 - protein, 112 aa, Artificial Sequence; identical to SEQ ID NO: 3191
  Description of Artificial Sequence: Synthetic light chain variable domain

SEQ ID NO: 3245 - protein, 111 aa, Artificial Sequence; identical to SEQ ID NO: 3192
  Description of Artificial Sequence: Synthetic light chain variable domain

SEQ ID NO: 3246 - protein, 112 aa, Artificial Sequence; identical to SEQ ID NO: 3193
  Description of Artificial Sequence: Synthetic light chain variable domain

SEQ ID NO: 3247 - protein, 106 aa, Artificial Sequence; identical to SEQ ID NO: 3194
  Description of Artificial Sequence: Synthetic light chain variable domain

SEQ ID NO: 3248 - protein, 112 aa, Artificial Sequence; identical to SEQ ID NO: 3195
  Description of Artificial Sequence: Synthetic light chain variable domain

SEQ ID NO: 3249 - protein, 106 aa, Artificial Sequence; identical to SEQ ID NO: 3196
  Description of Artificial Sequence: Synthetic light chain variable domain

SEQ ID NO: 3250 - protein, 107 aa, Artificial Sequence; identical to SEQ ID NO: 3197
  Description of Artificial Sequence: Synthetic light chain variable domain

SEQ ID NO: 3251 - protein, 109 aa, Artificial Sequence; identical to SEQ ID NO: 3198
  Description of Artificial Sequence: Synthetic light chain variable domain

SEQ ID NO: 3252 - protein, 105 aa, Artificial Sequence; identical to SEQ ID NO: 3199
  Description of Artificial Sequence: Synthetic light chain variable domain

SEQ ID NO: 3253 - protein, 107 aa, Artificial Sequence; identical to SEQ ID NO: 3200
  Description of Artificial Sequence: Synthetic light chain variable domain

SEQ ID NO: 3254 - protein, 112 aa, Artificial Sequence; identical to SEQ ID NO: 3201
  Description of Artificial Sequence: Synthetic light chain variable domain

SEQ ID NO: 3255 - protein, 107 aa, Artificial Sequence; identical to SEQ ID NO: 3202
  Description of Artificial Sequence: Synthetic light chain variable domain

SEQ ID NO: 3256 - protein, 108 aa, Artificial Sequence; identical to SEQ ID NO: 3203
  Description of Artificial Sequence: Synthetic light chain variable domain

SEQ ID NO: 3257 - protein, 109 aa, Artificial Sequence; identical to SEQ ID NO: 3204
  Description of Artificial Sequence: Synthetic light chain variable domain

SEQ ID NO: 3258 - protein, 113 aa, Artificial Sequence
  Description of Artificial Sequence: Synthetic light chain variable domain
DIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKS

SEQ ID NO: 3259 - protein, 111 aa, Artificial Sequence
  Description of Artificial Sequence: Synthetic light chain variable domain
DIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIK

SEQ ID NO: 3260 - protein, 111 aa, Artificial Sequence
  Description of Artificial Sequence: Synthetic light chain variable domain
LPVLTQPPSTSGTPGQRVTVSCSGSSSNIGSNVVFWYQQLPGTAPKLVIYRNNQRPSGVPDRFSVSKSGTSASLAISGLRSEDEADYYCAAWDDSLSGYVFGTGTKVTVLG

SEQ ID NO: 3261 - protein, 111 aa, Artificial Sequence
  Description of Artificial Sequence: Synthetic light chain variable domain
DIVLTGSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIK

SEQ ID NO: 3262 - protein, 111 aa, Artificial Sequence
  Description of Artificial Sequence: Synthetic light chain variable domain
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 3263 - protein, 112 aa, Artificial Sequence
  Description of Artificial Sequence: Synthetic light chain variable domain
DIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIK

SEQ ID NO: 3264 - protein, 112 aa, Artificial Sequence
  Description of Artificial Sequence: Synthetic light chain variable domain
DIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIK

SEQ ID NO: 3265 - protein, 112 aa, Artificial Sequence
  Description of Artificial Sequence: Synthetic light chain variable domain
QSVVTQPPSVSGAPGQRVTISCSGSSSNIGARYDVQWYQQLPGTAPKLLIFGNNNRPSGVPDRFSGSKSGTSASLAITGLQAEDEADYYCQSYDSSLSASVFGGGTKLTVLG

SEQ ID NO: 3266 - protein, 111 aa, Artificial Sequence; identical to SEQ ID NO: 3261
  Description of Artificial Sequence: Synthetic light chain variable domain

SEQ ID NO: 3267 - protein, 108 aa, Artificial Sequence
  Description of Artificial Sequence: Synthetic light chain variable domain
EIVLTQSPGTLSLSPGSEATLSCRGGQSVSSSYLAWYQQKPGQAPRLLMYDASIRATGIPDRFSGSGSGTDFTLTISRLEPEDFAVYYCQQYQSWPLTFGQGTKVEIK

SEQ ID NO: 3268 - protein, 111 aa, Artificial Sequence; identical to SEQ ID NO: 3262
  Description of Artificial Sequence: Synthetic light chain variable domain

SEQ ID NO: 3269 - protein, 111 aa, Artificial Sequence
  Description of Artificial Sequence: Synthetic light chain variable domain
QAVLTQPPSASGTPGQRVTISCSGSSSNIGSNTVNWYRQLPGTAPKLLIYSNNQRPSGVPDRFSGSKSGTSASLAISGLQSEDEADYYCAAWDDSLNGVVFGGGTKLTVLG

SEQ ID NO: 3270 - protein, 111 aa, Artificial Sequence
  Description of Artificial Sequence: Synthetic light chain variable domain
QSVLTQPPSVSVAPRQRVTISCSGSSSNIGHNDVSWYQHLPGKAPRLLIYFDDLLPSGVSDRFSASKSGTSASLAISGLQSEDEADYYCAAWDGSLNAFVFGTGTKVTVLG

SEQ ID NO: 3271 - protein, 112 aa, Artificial Sequence
  Description of Artificial Sequence: Synthetic light chain variable domain
LPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLG

SEQ ID NO: 3272 - protein, 117 aa, Artificial Sequence
  Description of Artificial Sequence: Synthetic light chain variable domain
QPVLTQPPSASASLGASVTLTCTLSSGYSNYKVDWYQQRPGKGPRFVMRVGTGGIVGSKGDGIPDRFSVLGSGLNRYLTIKNIQEEDEGDYHCGADHGSGSNFVYVFGTGTKVTVLG

SEQ ID NO: 3273 - protein, 108 aa, Artificial Sequence
  Description of Artificial Sequence: Synthetic light chain variable domain
DIQLTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKR

SEQ ID NO: 3274 - protein, 117 aa, Artificial Sequence
  Description of Artificial Sequence: Synthetic light chain variable domain
QPVLTQPPSASASLGASVTLTCTLSNDYTNYKVDWYQQRPGKGPRFVMRVGPGGIVGSKGDGIPDRFSVLGSGLNRYLTIKNIQEEDESDYHCGADHGTGSNFVYVFGGGTKLTVLG

SEQ ID NO: 3275 - protein, 117 aa, Artificial Sequence
  Description of Artificial Sequence: Synthetic light chain variable domain
QPVLTQPPSASASLGASVTLTCTLSSGYSNYKVDWYQQRPGKGPRFLMRVDTGGIVGSKGDGIPDRFSVSGSGLNRYLTIKNIQEEDESDYHCGADHGSGSNFVWVFGGGTKLTVLG

SEQ ID NO: 3276 - protein, 113 aa, Artificial Sequence
  Description of Artificial Sequence: Synthetic light chain variable domain
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKR

SEQ ID NO: 3277 - protein, 111 aa, Artificial Sequence
  Description of Artificial Sequence: Synthetic light chain variable domain
SYVLTQPPSASGTPGQRVTISCSGSSSNIGSNTVNWYQQVPGTAPKLLIYSNNQRPSGVPDRFSGSKSGASASLAISWLQSEDEADYYCAAWDDSLNGWVFGGGTKLTVLG

SEQ ID NO: 3278 - protein, 111 aa, Artificial Sequence
  Description of Artificial Sequence: Synthetic light chain variable domain
QAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLG

SEQ ID NO: 3279 - protein, 105 aa, Artificial Sequence
  Description of Artificial Sequence: Synthetic light chain variable domain
QSALTQPASVSASPGQSIAISCTGTSSDVGWYQQHPGKAPKLMIYEDSKRPSGVSNRFSGSKSGNTASLTISGLQAEDEADYYCSSNTRSSTLVFGGGTKLTVLG

SEQ ID NO: 3280 - protein, 112 aa, Artificial Sequence
  Description of Artificial Sequence: Synthetic light chain variable domain
QSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLG

SEQ ID NO: 3281 - protein, 111 aa, Artificial Sequence
  Description of Artificial Sequence: Synthetic light chain variable domain
QPVLTQPPSVSEAPRQRVTISCSGSSSNIGNNAVNWYQQLPGKAPKLLIYFDDLLSSGVSDRFSGSKSGTSASLAISGLQSEDEADYYCAAWDDSLNGYVFGTGTKVTVLG

SEQ ID NO: 3282 - protein, 112 aa, Artificial Sequence
  Description of Artificial Sequence: Synthetic light chain variable domain
QAVLTQPPSASGTPGQRVTISCSGSSSNIGSNYVFWYQQLPGTAPKLLIYSNNQRPSGVPDRFSGSKSGTSASLAISGLRSEDEADYYCAAWDDSLSASYVFGTGTKVTVLG

SEQ ID NO: 3283 - protein, 111 aa, Artificial Sequence
  Description of Artificial Sequence: Synthetic light chain variable domain
SYELTQPPSASGTPGQRVTMSCSGTSSNIGSHSVNWYQQLPGTAPKLLIYTNNQRPSGVPDRFSGSKSGTSASLAISGLQSEDEADYYCAAWDGSLNGLVFGGGTKLTVLG

SEQ ID NO: 3284 - protein, 111 aa, Artificial Sequence
  Description of Artificial Sequence: Synthetic light chain variable domain
DIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIK

SEQ ID NO: 3285 - protein, 111 aa, Artificial Sequence
  Description of Artificial Sequence: Synthetic light chain variable domain
DIVLTQSPASLAVSLGERATINCRASESVSVIGAHLIHWYQQKPGQPPKLLIYLASNLETGVPARFSGSGSGTDFTLTISSLQAEDAAIYSCLQSRIFPRTFGQGTKLEIK

SEQ ID NO: 3286 - protein, 111 aa, Artificial Sequence
  Description of Artificial Sequence: Synthetic light chain variable domain
DIVLTQSPASLAMSLGERATISCRASESVSVIGAHLIHWYQQKPGQPPKLLIYLASNLETGVPARFSGSGSGTDFTLTISRVQAEDAAIYSCLQSRIFPRTFGQGTKLEIK

SEQ ID NO: 3287 - protein, 112 aa, Artificial Sequence; identical to SEQ ID NO: 3263
  Description of Artificial Sequence: Synthetic light chain variable domain

SEQ ID NO: 3288 - protein, 112 aa, Artificial Sequence; identical to SEQ ID NO: 3264
  Description of Artificial Sequence: Synthetic light chain variable domain

SEQ ID NO: 3289 - protein, 107 aa, Artificial Sequence
  Description of Artificial Sequence: Synthetic light chain variable domain
DIQMTQSPSSLSASVGDRVTITCRANQGISNNLNWYQQKPGKAPKPLIYYTSNLQSGVPSRFSGSGSGTDYTLTISSLQPEDFATYYCQQFTSLPYTFGQGTKLEIK

SEQ ID NO: 3290 - protein, 214 aa, Artificial Sequence
  Description of Artificial Sequence: Synthetic light chain variable domain
DIQMTQSPILLSASVGDRVTITCKASQNIDKYLNWYQQRTNGSPRLLIYNTNNLQTGVPSRFSGSGSGTDFTFTISSLQPEDEADYYCLQHISRPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3291 - protein, 214 aa, Artificial Sequence
  Description of Artificial Sequence: Synthetic light chain variable domain
DIQMTQSPILLSASVGDRVTITCKASQNIDKYLNWYQQRTNGSPRLLIYNTNNLQTGVPSRFSGSGSGTDFTFTISSLQPEDIADYYCLQHISRPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3292 - protein, 214 aa, Artificial Sequence; identical to SEQ ID NO: 3290
  Description of Artificial Sequence: Synthetic light chain variable domain

SEQ ID NO: 3293 - protein, 106 aa, Artificial Sequence
  Description of Artificial Sequence: Synthetic light chain variable domain
QIVLSQSPAILSASPGEKVTMTCRASSSVSYMHWYQQKPGSSPKPWIYATSNLASGVPVRFSGSGSGTSYSLTISRVEAEDAATYYCQQWSSNPLTFGAGTKLELK

SEQ ID NO: 3294 - protein, 106 aa, Artificial Sequence
  Description of Artificial Sequence: Synthetic light chain variable domain
DIQLTQSPSSLSASVGDRATITCRASSSVSYMHWYQQKPGKAPKPWAYATSNLASGVPSRFSGSGSGTDYTLTISSLQPEDFATYYCQQWSSNPLTFGGGTKVEIK

SEQ ID NO: 3295 - protein, 106 aa, Artificial Sequence
  Description of Artificial Sequence: Synthetic light chain variable domain
DIQLTQSPSSLSASVGDRVTISCRASSSVSYMHWYQQKPGKAPKPWIYASSNLASGVPSRFSGSGSGTDYTLTISSLQPEDFATYYCQQWSSNPLTFGGGTKVEIK

SEQ ID NO: 3296 - protein, 106 aa, Artificial Sequence
  Description of Artificial Sequence: Synthetic light chain variable domain
DIQMTQSPSSLSASVGDRATITCRASSSVSYMHWYQQKPGKAPKPWIYASSNLASGVPSRFSGSGSGTDYTLTISSLQPEDFATYYCQQWSSNPLTFGGGTKVEIK

SEQ ID NO: 3297 - protein, 106 aa, Artificial Sequence
  Description of Artificial Sequence: Synthetic light chain variable domain
DIQMTQSPSSLSASVGDRVTISCRASSSVSYMHWYQQKPGKAPKPWAYATSNLASGVPSRFSGSGSGTDYTLTISSLQPEDFATYYCQQWSSNPLTFGGGTKVEIK

SEQ ID NO: 3298 - protein, 113 aa, Artificial Sequence; identical to SEQ ID NO: 2373
  Description of Artificial Sequence: Synthetic light chain variable domain

SEQ ID NO: 3299 - protein, 134 aa, Artificial Sequence
  Description of Artificial Sequence: Synthetic light chain variable domain
MESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKR

SEQ ID NO: 3300 - protein, 107 aa, Artificial Sequence
  Description of Artificial Sequence: Synthetic light chain variable domain
DVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIK

SEQ ID NO: 3301 - protein, 111 aa, Artificial Sequence
  Description of Artificial Sequence: Synthetic light chain variable domain
DIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELK

SEQ ID NO: 3302 - protein, 113 aa, Artificial Sequence
  Description of Artificial Sequence: Synthetic light chain variable domain
MADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKR

SEQ ID NO: 3303 - protein, 127 aa, Artificial Sequence; identical to SEQ ID NO: 771
  Description of Artificial Sequence: Synthetic light chain variable domain

SEQ ID NO: 3304 - protein, 113 aa, Artificial Sequence
  Description of Artificial Sequence: Synthetic light chain variable domain
MADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKR

SEQ ID NO: 3305 - protein, 113 aa, Artificial Sequence
  Description of Artificial Sequence: Synthetic light chain variable domain
MADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKR

SEQ ID NO: 3306 - protein, 113 aa, Artificial Sequence
  Description of Artificial Sequence: Synthetic light chain variable domain
MADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKR

SEQ ID NO: 3307 - protein, 111 aa, Artificial Sequence
  Description of Artificial Sequence: Synthetic light chain variable domain
MMSQSPSSLAVSVGEKFTMTCKSSQSLFFGSTQKNYLAWYQQKPGQSPKLLIYWASTRESGVPDRFTGSGSGTDFTLAISSVMPEDLAVYYCQQYYNYPWTFGGGTKLEIK

SEQ ID NO: 3308 - protein, 113 aa, Artificial Sequence
  Description of Artificial Sequence: Synthetic light chain variable domain
MADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKR

SEQ ID NO: 3309 - protein, 113 aa, Artificial Sequence
  Description of Artificial Sequence: Synthetic light chain variable domain
MADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKR

SEQ ID NO: 3310 - protein, 107 aa, Artificial Sequence
  Description of Artificial Sequence: Synthetic light chain variable domain
DIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 3311 - protein, 107 aa, Artificial Sequence
  Description of Artificial Sequence: Synthetic light chain variable domain
DIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 3312 - protein, 107 aa, Artificial Sequence
  Description of Artificial Sequence: Synthetic light chain variable domain
DIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 3313 - protein, 107 aa, Artificial Sequence
  Description of Artificial Sequence: Synthetic light chain variable domain
DIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 3314 - protein, 107 aa, Artificial Sequence
  Description of Artificial Sequence: Synthetic light chain variable domain
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 3315 - protein, 107 aa, Artificial Sequence
  Description of Artificial Sequence: Synthetic light chain variable domain
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 3316 - protein, 107 aa, Artificial Sequence
  Description of Artificial Sequence: Synthetic light chain variable domain
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 3317 - protein, 107 aa, Artificial Sequence
  Description of Artificial Sequence: Synthetic light chain variable domain
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 3318 - protein, 114 aa, Artificial Sequence
  Description of Artificial Sequence: Synthetic light chain variable domain
DIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKCDI

SEQ ID NO: 3319 - protein, 107 aa, Artificial Sequence
  Description of Artificial Sequence: Synthetic light chain variable domain
DIVMTQSPSSVSASVGDRVTITCRASQVDSAVAWYQQKPGKAPKALIYSASYRYSGVPSRFSGRGSGTDFTLTISSLQPEDFATYYCQQYYSTPWTFGQGTKVEIKR

SEQ ID NO: 3320 - protein, 107 aa, Artificial Sequence
  Description of Artificial Sequence: Synthetic light chain variable domain
DIQMTQSPSSVSASVGDRVTITCRASQNVDSAVAYQQKPGKAPKALIYSASYRYSGVPSRFSGRGSGTDFTLTISSLQPEDFATYYCQQYYSTPWTFGQGTKVEIKR

SEQ ID NO: 3321 - protein, 107 aa, Artificial Sequence
  Description of Artificial Sequence: Synthetic light chain variable domain
DIQMTQSPSSVSASVGDRVTITCRASQNVDSAVAYQQKPGKAPKALIYSASYRYSGVPSRFSGSGSGTDFTLTISSLQPEDFATYYCQQYYSTPWTFGQGTKVEIKR

SEQ ID NO: 3322 - protein, 107 aa, Artificial Sequence
  Description of Artificial Sequence: Synthetic light chain variable domain
DIQMTQSPSSVSASVGDRVTITCRASQNVDSAVAYQQKPGKAPKLLIYSASYRYSGVPSRFSGSGSGTDFTLTISSLQPEDFATYYCQQYYSTPWTFGQGTKVEIKR

SEQ ID NO: 3323 - protein, 107 aa, Artificial Sequence
  Description of Artificial Sequence: Synthetic light chain variable domain
DIQMTQSPSSVSASVGDRVTITCKASQNVDSAVAYQQKPGKAPKLLIYSASYRYSGVPSRFSGSGSGTDFTLTISSLQPEDFATYYCQQYYSTPWTFGQGTKVEIKR

SEQ ID NO: 3324 - protein, 107 aa, Artificial Sequence
  Description of Artificial Sequence: Synthetic light chain variable domain
DIQMTQSPSSVSASVGDRVTITCKASQNVDSAVAYQQKPGKAPKALIYSASYRYSGVPSRFSGSGSGTDFTLTISSLQPEDFATYYCQQYYSTPWTFGQGTKVEIKR

SEQ ID NO: 3325 - protein, 107 aa, Artificial Sequence
  Description of Artificial Sequence: Synthetic light chain variable domain
DIQMTQSPSSVSASVGDRVTITCRASQNVDSAVAYQQKPGKAPKALIYSASYRYSGVPSRFSGSGSGTDFTLTISSLQPEDLATYYCQQYYSTPWTFGQGTKVEIKR

SEQ ID NO: 3326 - protein, 107 aa, Artificial Sequence
  Description of Artificial Sequence: Synthetic light chain variable domain
DIQMTQSPSSVSASVGDRVTITCKASQVDSAVAWYQQKPGKAPKALIYSASYRYSGVPDRFSGSGSGTDFTLTISSLQPEDLATYYCQQYYSTPWTFGQGTKVEIKR

SEQ ID NO: 3327 - protein, 107 aa, Artificial Sequence
  Description of Artificial Sequence: Synthetic light chain variable domain
DIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIK

SEQ ID NO: 3328 - protein, 108 aa, Artificial Sequence
  Description of Artificial Sequence: Synthetic light chain variable domain
SSELTQDPAVSVALGQTVRITCQGDSLRSYYTNWFQQKPGQAPLLVVYAKNKRPSGIPDRFSGSSSGNTASLTITGAQAEDEADYYCHSRDSGGNHVLFGGGTKLTVL

SEQ ID NO: 3329 - protein, 108 aa, Artificial Sequence
  Description of Artificial Sequence: Synthetic light chain variable domain
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 3330 - protein, 111 aa, Artificial Sequence
  Description of Artificial Sequence: Synthetic light chain variable domain
QSVLTQPPSASGTPGQRVTISCSGSSSNVGSNFVYWYQQFPGTAPKLLIYRNNQRPSGVPDRFSGSKSGTSASLAISGLRSEDEADYYCAAWDDTLNGHYVFGGGTKLTVL

SEQ ID NO: 3331 - protein, 110 aa, Artificial Sequence
  Description of Artificial Sequence: Synthetic light chain variable domain
RSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVL

SEQ ID NO: 3332 - protein, 110 aa, Artificial Sequence
  Description of Artificial Sequence: Synthetic light chain variable domain
SYVLTQPPSASGTPGQRVTISCSGSSSNIGSNYVYWYQQLPGTAPKLLIYRNNQRPSGVPDRFSGSKSGTSASLAISGLQSEDEADYYCEAWDDNVDGPVFGGGTKLTVL

SEQ ID NO: 3333 - protein, 111 aa, Artificial Sequence
  Description of Artificial Sequence: Synthetic light chain variable domain
QAVLTQPSSVSGAPGQRVTISCTGSSSNIGAGYDVHWYQQLPGTAPKLLIYGNSNRPSGVPDRFSGSKSGTSASLAVTGLQAEDEADYYCQSYDSSLSDVVFGGGTKLTVL

SEQ ID NO: 3334 - protein, 107 aa, Artificial Sequence
  Description of Artificial Sequence: Synthetic light chain variable domain
EIVMTQSPSSLPASVGDRVTITCRASQNIKTYLHWYQQKPGKAPNLLIYAASNLQIGVPSRFSGSGSGTDFTLTISSLQPEDFATYFCQQSYITPPTFGQGTRLEIK

SEQ ID NO: 3335 - protein, 214 aa, Artificial Sequence
  Description of Artificial Sequence: Synthetic light chain variable domain
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3336 - protein, 237 aa, Artificial Sequence
  Description of Artificial Sequence: Synthetic light chain variable domain
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSGGGGSNYHLENEVARLKKLGGGGSDSTYSLSSTLTLSKADYEKHKVYACEVTHQGLSSPVTKSFNRGEC

SEQ ID NO: 3337 - protein, 107 aa, Artificial Sequence
  Description of Artificial Sequence: Synthetic light chain variable domain
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIT

SEQ ID NO: 3338 - protein, 107 aa, Artificial Sequence; identical to SEQ ID NO: 3337
  Description of Artificial Sequence: Synthetic light chain variable domain

SEQ ID NO: 3339 - protein, 115 aa, Artificial Sequence
  Description of Artificial Sequence: Synthetic light chain variable domain
DIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRAD

SEQ ID NO: 3340 - protein, 107 aa, Artificial Sequence; identical to SEQ ID NO: 3337
  Description of Artificial Sequence: Synthetic light chain variable domain

SEQ ID NO: 3341 - protein, 112 aa, Artificial Sequence
  Description of Artificial Sequence: Synthetic light chain variable domain
DIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELK

SEQ ID NO: 3342 - protein, 106 aa, Artificial Sequence
  Description of Artificial Sequence: Synthetic light chain variable domain
QSALTQPRSVSGFPGQSVTISCTGTTSDDVSWYQQHPGKAPQLMLYDVSKRPSGVPHRFSGSRSGRAASLIISGLQTEDEADYFCCSYAGRYNSVLFGGGTKLTVL

SEQ ID NO: 3343 - protein, 106 aa, Artificial Sequence
  Description of Artificial Sequence: Synthetic light chain variable domain
QSALTQPRSVSGFPGQSVTISCTGTTSDDVSWYQQHPGKAPQLMLYDVSKRPSGVPHRFSGSRSGRAASLIISGLQTEDEADYFCSSYAGRYNSVLFGGGTKLTVL

SEQ ID NO: 3344 - protein, 110 aa, Artificial Sequence
  Description of Artificial Sequence: Synthetic light chain variable domain
QSALTQPASVSGSPGQSITIFCTGTSSDVGGYNYVSWYQQLPGTAPKLLIYSNNQRPSGVPDRFSGSKSGTSASLAISGLRSEDEADYYCAAWDDSLSVVFGGGTKLTVL

SEQ ID NO: 3345 - protein, 109 aa, Artificial Sequence
  Description of Artificial Sequence: Synthetic light chain variable domain
QSVLTQPPSVSAAPGQEVTISCSGSSSNIGNNYVSWYQQLPGTAPKLLIYDNDKRPSGIPDRFSGSKSGTSATLGITGLQTGDEADYYCGTWDGNLSAVFGGGTKVTVL

SEQ ID NO: 3346 - protein, 108 aa, Artificial Sequence
  Description of Artificial Sequence: Synthetic light chain variable domain
SYELTQDPAVSVALGQTVRITCQGDSLRSYYASWYQQKPGQAPVLVIYDKNNRPSGIPDRFSGSSSGNTASLTITGAQAEDEADYYCNSRDSSGNNWVFGGGTKLTVL

SEQ ID NO: 3347 - protein, 107 aa, Artificial Sequence
  Description of Artificial Sequence: Synthetic light chain variable domain
AIQLTQSPSFLSASVGDRVTITCRASQGISSYLNWYQQRAGKAPELLIYAASNLQSGVPSRFSGSGSGTDFTLTITSVQPEDFATYFCQQGDAFPLTFGPGTKVTIR

SEQ ID NO: 3348 - protein, 109 aa, Artificial Sequence
  Description of Artificial Sequence: Synthetic light chain variable domain
EIVLTQSPATLSLSPGETATLSCRASQSINHYLAWYQQKPGQAPRLLIYDASNRATGIPARFSGSGSGTDFTLTISSLEPEDFATYYCQQSYSHPRMYTFGQGTKLEIK

SEQ ID NO: 3349 - protein, 109 aa, Artificial Sequence
  Description of Artificial Sequence: Synthetic light chain variable domain
AIRMTQSPSSLSASVGDRVTVTCQASQDISNYLNWYQQKPGRAPKLLIYDASNVKAGVPSRFSGGGSGTDFTLTISSLQPEDFATYYCQQSYSTPQAYTFGQGTKLDIK

SEQ ID NO: 3350 - protein, 111 aa, Artificial Sequence
  Description of Artificial Sequence: Synthetic light chain variable domain
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLNRDWVFGGGTKLTVL

SEQ ID NO: 3351 - protein, 109 aa, Artificial Sequence
  Description of Artificial Sequence: Synthetic light chain variable domain
  MOD_RES (5)..(6): Any amino acid
  MOD_RES (8)..(9): Any amino acid
  MOD_RES (93)..(93): Any amino acid
  MOD_RES (104)..(104): Any amino acid
QSVLXXPXXASGSPGQSVTVSCTGTGRDIGAYDYVSWYQQHPGKAPKLLIYGVNKRPSGVPDRFSGSKSDNTASLTVSGLQVEDEADYYCSSXAGRKYVFGTGXKVTVL

SEQ ID NO: 3352 - protein, 112 aa, Artificial Sequence
  Description of Artificial Sequence: Synthetic light chain variable domain
  MOD_RES (61)..(61): Any amino acid
QSALTQPASVSGSPGQSITISCTETSSDLGGYNYVSWYQHRPGKAPKLIIYDVTVRPSGVXDRFSGSKSGNTASLTISGLQAEDEADYYCGSYTSSSTLLWVFGGGTKLTVL

SEQ ID NO: 3353 - protein, 112 aa, Artificial Sequence
  Description of Artificial Sequence: Synthetic light chain variable domain
QSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLTVL

SEQ ID NO: 3354 - protein, 110 aa, Artificial Sequence
  Description of Artificial Sequence: Synthetic light chain variable domain
QSALTQPASVSGSPGHSITISCTGTRSDVGGFDYVSWYQHNPGKAPKLIIYDVTKRPSGVSNRFSGAKSGITASLTISGLQAEDEADYYCTSYRPGPTFVFGTGTKLDIK

SEQ ID NO: 3355 - protein, 112 aa, Artificial Sequence
  Description of Artificial Sequence: Synthetic light chain variable domain
QSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLDIK

SEQ ID NO: 3356 - protein, 111 aa, Artificial Sequence
  Description of Artificial Sequence: Synthetic light chain variable domain
QSVLTQPRSLSGSPGQSVTIACTGASTDVGGYNYVSWYQQHPGKAPKLMIYDVNKRPSGVPDRFSGSKSGNTAFLTISGLQAEDEADYYCCSYAGSYTFEVFGGGTKLTVL

SEQ ID NO: 3357 - protein, 111 aa, Artificial Sequence
  Description of Artificial Sequence: Synthetic light chain variable domain
QLVLTQPPSVSGSPGQSVTFSCTGASSDVGGYDHVSWYQHHPGKGPKLLIYDVSKRPSGVPDRFSGSKSGNTASLTISGLQAEDEADYYCCSFAGYYTYWLFGGGTKVTVL

SEQ ID NO: 3358 - protein, 106 aa, Artificial Sequence
  Description of Artificial Sequence: Synthetic light chain variable domain
QSALTQPRSVSGFPGQSVTISCTGTTSDDVSWYQQHPGKAPQLMLYDVSKRPSGVPHRFSGSRSGRAASLIISGLQTEDEADYFCCSYAGRYNSVPFGGGTKLTVL

SEQ ID NO: 3359 - protein, 99 aa, Artificial Sequence
  Description of Artificial Sequence: Synthetic light chain variable domain
SYVLTQPPSASGTPGQRVTISCSGSSSNIGSNTVNWYQQFPGTAPKLLIYSNNQRPSGVPDRFSGSKSGTSASLAISGLQSEDEAEYYCAAWDDSLNVV

SEQ ID NO: 3360 - protein, 110 aa, Artificial Sequence
  Description of Artificial Sequence: Synthetic light chain variable domain
QSVLTQPPSVSAAPGQKVTISCSGSSSNIGNNYVSWYQQLPGTAPKLLIYDNNKRPSGIPDRFSGSKSGTSATLGITGLQTGDEGDYYCGTWDISLRFGVFGGGTKVTVL

SEQ ID NO: 3361 - protein, 111 aa, Artificial Sequence
  Description of Artificial Sequence: Synthetic light chain variable domain
QSVLTQPRSVSGSPGQSVTISCTGPISGVGDYTSVSWYQHYPGKTPKLIIYDVTQRPSGVPNRFSGSKSGNTASLTISGLQADDEADYYCCSYEAPTHTYVFGTGTKLTVL

SEQ ID NO: 3362 - protein, 124 aa, Artificial Sequence
  Description of Artificial Sequence: Synthetic light chain variable domain
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 3363 - protein, 239 aa, Artificial Sequence
  Description of Artificial Sequence: Synthetic light chain variable domain
MRCLAEFLGLLVLWIPGAIGDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3364 - protein, 111 aa, Artificial Sequence
  Description of Artificial Sequence: Synthetic light chain variable domain
QAVLTQPRSVSGSPGQSVTISCTGISSGVDSHRYVSWYQHHPGKAPKLMIYDFSKRPSGVPDRFSGSKSGNTASLTISGLQAEDEADYYCSSYAAISPNYVFGTGTKLTVL

SEQ ID NO: 3365 - protein, 110 aa, Artificial Sequence
  Description of Artificial Sequence: Synthetic light chain variable domain
QSALTQPASVSGSPGHSITISCTGTRSDVGGFDYVSWYQHNPGKAPKLIIYDVTKRPSGVSNRFSGAKSGITASLTISGLQAEDEADYYCTSYRPGPTFVFGTGTKLTVL

SEQ ID NO: 3366 - protein, 111 aa, Artificial Sequence
  Description of Artificial Sequence: Synthetic light chain variable domain
QSALTQPASVSGSPGQSITISCTGTSSDVGAYNFVSWYQQLPGTAPKFLIYDNNKRPPGIPDRFSGSKSGTSATLGITGLQTGDEADYYCATWDSGLSAVVFGGGTKLTVL

SEQ ID NO: 3367 - protein, 109 aa, Artificial Sequence
  Description of Artificial Sequence: Synthetic light chain variable domain
AIRMTQSPSSLSASVGDRVTVTCQASQDISNYLNWYQQKPGRAPKLLIYDASNVKAGVPSRFSGGGSGTDFTLTISSLQPEDFATYYCQQSYSTPQAYTFGQGTKLEIK

SEQ ID NO: 3368 - protein, 108 aa, Artificial Sequence
  Description of Artificial Sequence: Synthetic light chain variable domain
AIRMTQSPSTLSASVGDRVTITCRASQSISHYLAWYQQKPGKAPKLLIFDASRLASGVPSRFSGSGSGTDFTLTISSLQPEDFATYYCQQSYGAPMFTFGPGTRVDLK

SEQ ID NO: 3369 - protein, 107 aa, Artificial Sequence
  Description of Artificial Sequence: Synthetic light chain variable domain
DIQLTQSPSTLSASVGDRVTITCRASQSISRWLAWYQQKPGKAPKLLIYDASNLETGVPSRFSGSGSGTDFTFTISSLQPEDIATYYCQQYDNLPLTFGGGTKVEIK

SEQ ID NO: 3370 - protein, 109 aa, Artificial Sequence
  Description of Artificial Sequence: Synthetic light chain variable domain
EIVLTQSPATLSLSPGETATLSCRASQSINHYLAWYQQKPGQAPRLLIYDASNRATGIPARFSGSGSGTDFTLTISSLEPEDFATYYCQQSYSHPRMYTFGQGTKLDIK

SEQ ID NO: 3371 - protein, 111 aa, Artificial Sequence
  Description of Artificial Sequence: Synthetic light chain variable domain
QAVLTQPRSVSGSPGQSVTISCTGISSGVDSHRYVSWYQHHPGKAPKLMIYDFSKRPSGVPDRFSGSKSGNTASLTISGLQAEDEADYYCCSYAAISPNYVFGTGTKLTVL

SEQ ID NO: 3372 - protein, 121 aa, Artificial Sequence
  Description of Artificial Sequence: Synthetic light chain variable domain
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 3373 - protein, 214 aa, Artificial Sequence
  Description of Artificial Sequence: Synthetic light chain variable domain
DIQMTQSPILLSASVGDRVTITCRASQDISKYLNWYQQRTNGSPRLLIYHTSRLHSGVPSRFSGSRSGTDFTLTISSLQPEDIADYYCQQGNTLPYTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3374 - protein, 214 aa, Artificial Sequence
  Description of Artificial Sequence: Synthetic light chain variable domain
DIQMTQSPILLSASVGDRVTITCRASQDISKYLNWYQQRTNGSPRLLIYHTSRLHSGVPSRFSGSRSGTDFTLTISSLQPEDEADYYCQQGNTLPYTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3375 - protein, 112 aa, Artificial Sequence
  Description of Artificial Sequence: Synthetic light chain variable domain
DVVLTQTPPTLLATIGQSVSISCRSSQSLLHSSGNTYLNWLLQRTGQSPQPLIYLVSKLESGVPNRFSGSGSGTDFTLKISGVEAEDLGVYYCMQFTHYPYTFGAGTKLELK

SEQ ID NO: 3376 - protein, 111 aa, Artificial Sequence
  Description of Artificial Sequence: Synthetic light chain variable domain
DTVLTQSPASLAVSLGQRATISCKASQSVDFDGDSFMNWYQQKPGQPPKLLIYTTSNLESGIPARFSASGSGTDFTLNIHPVEEEDTATYYCQQSNEDPYTFGGGTKLEIK

SEQ ID NO: 3377 - protein, 111 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDP

SEQ ID NO: 3378 - protein, 219 aa, Artificial Sequence
  Description of Artificial Sequence: Synthetic light chain variable domain
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3379 - protein, 103 aa, Artificial Sequence
  Description of Artificial Sequence: Synthetic light chain variable domain
NPVTLGTSASISCRSSKSLLHSNGITYLYWYLQKPGQSPQLLIYQMSNLVSGVPDRFSSSGSGTDFTLRISRVEAEDVGVYYCAQNLELPYTFGGGTKLEIKR

SEQ ID NO: 3380 - protein, 115 aa, Artificial Sequence
  Description of Artificial Sequence: Synthetic light chain variable domain
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTV

SEQ ID NO: 3381 - protein, 214 aa, Artificial Sequence
  Description of Artificial Sequence: Synthetic light chain variable domain
EIVLTQSPILLSLSPGERATLSCRASQSVSSYLAWYQQRTNGSPRLLIYDASNRATGIPARFSGSGSGTDFTLTISSLEPEDIADYYCQQRSNWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3382 - protein, 107 aa, Artificial Sequence
  Description of Artificial Sequence: Synthetic light chain variable domain
DIQLTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIK

SEQ ID NO: 3383 - protein, 108 aa, Artificial Sequence
  Description of Artificial Sequence: Synthetic light chain variable domain
DIQLTQSPSSLSASVGDRVTISCRASQDISNYLNWYQQKPGKAPKLLIYYTSILHSGVPSRFSGSGSGTDYTFTISSLQPEDIATYYCQQGNTLPWTFGGGTKVQIKR

SEQ ID NO: 3384 - protein, 107 aa, Artificial Sequence
  Description of Artificial Sequence: Synthetic light chain variable domain
DIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIK

SEQ ID NO: 3385 - protein, 108 aa, Artificial Sequence
  Description of Artificial Sequence: Synthetic light chain variable domain
DIQMTQSPSSLSASVGDRVTITCQASQDIIKYLNWYQQTPGKAPKLLIYEASNLQAGVPSRFSGSGSGTDYTFTISSLQPEDIATYYCQQYQSLPYTFGQGTKLQITR

SEQ ID NO: 3386 - protein, 113 aa, Artificial Sequence
  Description of Artificial Sequence: Synthetic light chain variable domain
DIQLTQSPSSLAVSAGENVTMSCKSSQSVLYSANHKNYLAWFQQKPGQSPKLLIYWASTRESGVPDRFTGSGSGTDFTLTISRVQVEDLAIYYCHQYLSSWTFGGGTKLEIKR

SEQ ID NO: 3387 - protein, 112 aa, Artificial Sequence
  Description of Artificial Sequence: Synthetic light chain variable domain
QSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLG

SEQ ID NO: 3388 - protein, 112 aa, Artificial Sequence
  Description of Artificial Sequence: Synthetic light chain variable domain
QSALTQPASVSGSPGQSITISCTGSRNDIGAYESVSWYQQHPGNAPKLIIHGVNNRPSGVFDRFSVSQSGNTASLTISGLQAEDEADYYCSSHTTTSTLYVFGTGTKVTVLG

SEQ ID NO: 3389 - protein, 111 aa, Artificial Sequence
  Description of Artificial Sequence: Synthetic light chain variable domain
QSALTQPASVSGSPGQSITISCTGSSSDVGGYNSVSWYQQHPGKAPKLMIYEVINRPSGVSHRFSGSKSGNTASLTISGLQAEDEADYYCSSYTSSSTYVFGTGTKVTVLG

SEQ ID NO: 3390 - protein, 112 aa, Artificial Sequence
  Description of Artificial Sequence: Synthetic light chain variable domain
QSALTQPASVSGSPGQSITISCTGSSSDIGGFNYVSWYQQHAGEAPKLMIYEVTNRPSGVSDRFSGSKSDNTASLTISGLQAEDEADYYCSSYASGSPLYVFGTGTKVTVLG

SEQ ID NO: 3391 - protein, 112 aa, Artificial Sequence
  Description of Artificial Sequence: Synthetic light chain variable domain
QSALTQPASVSGSPGQSITFSCTGTSSDIGGYNYVSWYQQHPGKAPKLMIYEVSNRPSGVSNRFSGTKSGNTASLTISGLQAEDEADYYCSSYTSSSTLYVFGTGTKLTVLG

SEQ ID NO: 3392 - protein, 112 aa, Artificial Sequence
  Description of Artificial Sequence: Synthetic light chain variable domain
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYVFGTGTKVTVLG

SEQ ID NO: 3393 - protein, 112 aa, Artificial Sequence
  Description of Artificial Sequence: Synthetic light chain variable domain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVLG

SEQ ID NO: 3394 - protein, 112 aa, Artificial Sequence
  Description of Artificial Sequence: Synthetic light chain variable domain
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYIFGTGTKVTVLG

SEQ ID NO: 3395 - protein, 111 aa, Artificial Sequence
  Description of Artificial Sequence: Synthetic light chain variable domain
QSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 3396 - protein, 110 aa, Artificial Sequence
  Description of Artificial Sequence: Synthetic light chain variable domain
SYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKLTVL

SEQ ID NO: 3397 - protein, 111 aa, Artificial Sequence
  Description of Artificial Sequence: Synthetic light chain variable domain
QSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVL

SEQ ID NO: 3398 - protein, 111 aa, Artificial Sequence
  Description of Artificial Sequence: Synthetic light chain variable domain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPYVFGTGTQLTVL

SEQ ID NO: 3399 - protein, 109 aa, Artificial Sequence
  Description of Artificial Sequence: Synthetic light chain variable domain
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLWVFGGGTKLTVL

SEQ ID NO: 3400 - protein, 106 aa, Artificial Sequence
  Description of Artificial Sequence: Synthetic light chain variable domain
SSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVL

SEQ ID NO: 3401 - protein, 111 aa, Artificial Sequence
  Description of Artificial Sequence: Synthetic light chain variable domain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVL

SEQ ID NO: 3402 - protein, 110 aa, Artificial Sequence
  Description of Artificial Sequence: Synthetic light chain variable domain
QSALTQPGSVSGSPGQSITISCTGTSSDVGGYNYVSWYQQHPGKAPKLIIYDVSSRPSGVSNRFSGSQSGNTASLTISGLQAEDEADYSCSSYAGSNTLVFGTGTKVTVL

SEQ ID NO: 3403 - protein, 111 aa, Artificial Sequence
  Description of Artificial Sequence: Synthetic light chain variable domain
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPWVFGGGTKLTVL

SEQ ID NO: 3404 - protein, 110 aa, Artificial Sequence
  Description of Artificial Sequence: Synthetic light chain variable domain
SYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVFGGGTKLTVL

SEQ ID NO: 3405 - protein, 112 aa, Artificial Sequence
  Description of Artificial Sequence: Synthetic light chain variable domain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVL

SEQ ID NO: 3406 - protein, 107 aa, Artificial Sequence
  Description of Artificial Sequence: Synthetic light chain variable domain
SSELTQDPAVSVALGQTVRITCQGDSLRSYYASWYQQKPGQAPVLVIYGKNHRPSGIPDRFSGSSSGDTDSLTITGAQAEDEADYYCHSRDSSGNHLFGGGTKLTVL

SEQ ID NO: 3407 - protein, 110 aa, Artificial Sequence
  Description of Artificial Sequence: Synthetic light chain variable domain
NFMLTQPHSVSESPGKTVTIPCTGSSGSFASSYVQWYQQRPGSAPATVIYEDNQRPSGVPDRFSGSVDSSSNSASLTISGLKTEDEAVYYCQSYDGATWVFGGGTKLTVL

SEQ ID NO: 3408 - protein, 110 aa, Artificial Sequence
  Description of Artificial Sequence: Synthetic light chain variable domain
QSALTQPASVSGSPGQSITISCSGTSSDVGGYNSVSWYQQYPGKAPKLMIYDVNNRPSGVSSRFSGSKSGNTASLTISGLQAEDEADYYCSSYTSSSTLFFGAGTKVTVL

SEQ ID NO: 3409 - protein, 109 aa, Artificial Sequence
  Description of Artificial Sequence: Synthetic light chain variable domain
SSELTQDPAVSVALGQTVRITCQGDSLRTYYATWYQQKPGQAPVLVFYDENNRPSGIPDRFSGSSSGNTASLTITGTQAEDEADYYCSSRDSSGNPSCVFGGGTKLTVL

SEQ ID NO: 3410 - protein, 110 aa, Artificial Sequence
  Description of Artificial Sequence: Synthetic light chain variable domain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 3411 - protein, 113 aa, Artificial Sequence
  Description of Artificial Sequence: Synthetic light chain variable domain
DVVMTQSPLSLPVTPGEPASISCRSSQSLLAGNGHNYLDWYLQKPGQSPQLLIYLGSNRASGVPDRFSGSGSGTDFTLKISRVEAEDVGVYYCMQALQNPLTFGGGTKLEIKR

SEQ ID NO: 3412 - protein, 110 aa, Artificial Sequence
  Description of Artificial Sequence: Synthetic light chain variable domain
QSALTQPASVSGSPGQSITISCTGSSSDVGGYNYVSWYQQHPGKAPKLMIYEVSNRPSGVSNRFSGSKSGNTASLTISGLQAEDEADYYCSSYTSSSTLVFGTGTKVTVL

SEQ ID NO: 3413 - protein, 110 aa, Artificial Sequence
  Description of Artificial Sequence: Synthetic light chain variable domain
QSALTQPASVSGSPGQSITISCTGTSSDVGGYNYVSWYQQHPGKAPKLMIYDVSNRPSGVSNRFSGSKSGNTASLTISGLQAEDEADYYCSSYASSSTLVFGGGTKVTVL

SEQ ID NO: 3414 - protein, 110 aa, Artificial Sequence
  Description of Artificial Sequence: Synthetic light chain variable domain
QSALTQPAYVSGSPGQSITISCTGTNSDVGRYNYVSWYQQHPGKAPKLMIYEVSYRPSGVSNRFSGSKSGNTASLTISGLQAEDEADYYCSSYTTSSTLDFGTGTKVTVL

SEQ ID NO: 3415 - protein, 110 aa, Artificial Sequence
  Description of Artificial Sequence: Synthetic light chain variable domain
QSALTQPASVSGSPGQSITISCTGTSSDVGGYKYVSWYQQHPGKAPKLMIYDVSNRPSGVSNRFSGSKSGNTASLTISGLQAEDEADYYCSSYTSSSTLVFGGGTKLTYL

SEQ ID NO: 3416 - protein, 111 aa, Artificial Sequence
  Description of Artificial Sequence: Synthetic light chain variable domain
HVILTQPPSASASLGASVKLTCTLSSGHSSYAIAWHQQQPEKGPRYLMKVNSDGSLSKGDGIPDRFSGSTSGAERYLTISSLQSEDEADYYCQTWGSGMAIFGGGTKLTVL

SEQ ID NO: 3417 - protein, 110 aa, Artificial Sequence
  Description of Artificial Sequence: Synthetic light chain variable domain
QSALTQPASASGSPGQSVTISCTGTSSDVGGYNYVSWYQQHPGKAPKLMIYEVSKRPSGVPDRFSGSKSGNTASLTISGLQAEDEADYYCSSYTSSGTLVFGGGTKLTVL

SEQ ID NO: 3418 - protein, 108 aa, Artificial Sequence
  Description of Artificial Sequence: Synthetic light chain variable domain
SSELTQDPAVSVALGQTVRITCQGDSLRSYYASWYQQKPGQAPVLVIYGKNNRPSGIPDRFSGSSSGNTASLTITGAQAEDEADYYRNSRDSSGNPYVFGTGTKVTVL

SEQ ID NO: 3419 - protein, 110 aa, Artificial Sequence
  Description of Artificial Sequence: Synthetic light chain variable domain
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKLTVL

SEQ ID NO: 3420 - protein, 114 aa, Artificial Sequence
  Description of Artificial Sequence: Synthetic light chain variable domain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKLEIKR

SEQ ID NO: 3421 - protein, 114 aa, Artificial Sequence
  Description of Artificial Sequence: Synthetic light chain variable domain
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQVLQTPPLTFGGGTKVDIKR

SEQ ID NO: 3422 - protein, 108 aa, Artificial Sequence
  Description of Artificial Sequence: Synthetic light chain variable domain
SYVLTQPPSVSVAPGKTATITCGGTNIGSKNVHWYQQKPGQAPVLAIYYDSDRPSGIPERFSGSNSGNTATLTISRVEAGDEADYFCQVWDSSSDHWVFGGGTKLTVL

SEQ ID NO: 3423 - protein, 108 aa, Artificial Sequence
  Description of Artificial Sequence: Synthetic light chain variable domain
SYELTQPPSVSVAPGETASIACGGHNIRSKNVHWYQQKPGQAPVLVISYDGDRPSGIPERFSGSNLGSTATLTISRVEAGDEADYYCQVWDSDSDHYVFGTGTKVTVL

SEQ ID NO: 3424 - protein, 107 aa, Artificial Sequence
  Description of Artificial Sequence: Synthetic light chain variable domain
DIQMTQSPSSLSASVGDRVTITCRASQSINTYLNWYQQKPGKPPKLLIYAASNLQSGVPSRFSGSGSGTHFTLTISSLQPDDFATYYCQQSYSSLLTFGGGTKLEIK

SEQ ID NO: 3425 - protein, 110 aa, Artificial Sequence
  Description of Artificial Sequence: Synthetic light chain variable domain
QSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVL

SEQ ID NO: 3426 - protein, 109 aa, Artificial Sequence
  Description of Artificial Sequence: Synthetic light chain variable domain
EIVLTQSPATLSVSPGERATLSCRASQSVTSNLAWYQQKPGQAPRLLIYAASTRATGIPARFSGSGSGTEFTLTISSMQSEDFAVYFCQQYHTWPPLTFGGGTKVEIKT

SEQ ID NO: 3427 - protein, 112 aa, Artificial Sequence
  Description of Artificial Sequence: Synthetic light chain variable domain
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKLEIK

SEQ ID NO: 3428 - protein, 111 aa, Artificial Sequence
  Description of Artificial Sequence: Synthetic light chain variable domain
EIVLTQSPLSLPVTPGEPASISCRSSQSLLYSDGYNYLDWYLQKPGQSPQLLIYLGSNRASGVPDRFSGSGSGTDFTLQISGVETEDVGVYYCMQALQTQSFGQGTKLEIK

SEQ ID NO: 3429 - protein, 108 aa, Artificial Sequence
  Description of Artificial Sequence: Synthetic light chain variable domain
SSELTQDPAVSVALGQTARITCQGDSLRSYFTSWYHQKPGQAPVLVIYGNNNRPSGIPDRFSGSSSGNTASLTITGAQAEDEGDYYCDSRDSSGDHLVFGGGTKLTVL

SEQ ID NO: 3430 - protein, 109 aa, Artificial Sequence
  Description of Artificial Sequence: Synthetic light chain variable domain
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHPVVFGGGTKLTVL

SEQ ID NO: 3431 - protein, 110 aa, Artificial Sequence
  Description of Artificial Sequence: Synthetic light chain variable domain
QSALTQPASVSGSPGQSITISCTGTSSDVGGYKHVSWYQHHPGKAPKLMIYDVSNRPSGVSNRFSGSKSGNTASLTVSGLQAEDEAHYYCVSYRNFNSLVFGTGTKVTVL

SEQ ID NO: 3432 - protein, 110 aa, Artificial Sequence
  Description of Artificial Sequence: Synthetic light chain variable domain
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTQLTVL

SEQ ID NO: 3433 - protein, 214 aa, Artificial Sequence
  Description of Artificial Sequence: Synthetic light chain variable domain
DIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3434 - protein, 113 aa, Artificial Sequence
  Description of Artificial Sequence: Synthetic light chain variable domain
DIQLTQSPSSLSASVGDRVTMSCKSSQSVLYSANHKNYLAWYQQKPGKAPKLLIYWASTRESGVPSRFSGSGSGTDFTFTISSLQPEDIATYYCHQYLSSWTFGGGTKVQIKR

SEQ ID NO: 3435 - protein, 110 aa, Artificial Sequence
  Description of Artificial Sequence: Synthetic light chain variable domain
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVLG

SEQ ID NO: 3436 - protein, 107 aa, Artificial Sequence
  Description of Artificial Sequence: Synthetic light chain variable domain
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 3437 - protein, 111 aa, Artificial Sequence
  Description of Artificial Sequence: Synthetic light chain variable domain
DIVMTQSPDSLAVSLGERATINCKASQSVDFDGDSYMNWYQQKPGQPPKLLIYAASNLESGVPDRFSGSGSGTDFTLTISSLQAEDVAVYYCQQSNEDPWTFGQGTKVEIK

SEQ ID NO: 3438 - protein, 107 aa, Artificial Sequence
  Description of Artificial Sequence: Synthetic light chain variable domain
DIQMTQSPTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIK

SEQ ID NO: 3439 - protein, 106 aa, Artificial Sequence
  Description of Artificial Sequence: Synthetic light chain variable domain
QIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIK

SEQ ID NO: 3440 - protein, 113 aa, Artificial Sequence
  Description of Artificial Sequence: Synthetic light chain variable domain
DIVMSQSPSSLAVSVGEKVTMSCKSSQSLLYSNNQKNYLAWYQQKPGQSPKLLIYWASTRESGVPDRFTGSGSGTDFTLTISSVKAEDLAVYYCHQYYTSPYTFGGGTNLEIK

SEQ ID NO: 3441 - protein, 112 aa, Artificial Sequence
  Description of Artificial Sequence: Synthetic light chain variable domain
DVLMTQTPLSLPVSLGDQASISCRSSQSIVHSDGNTYLEWYLRKPGQSPRLLIYKVSNRFSGVPDRFSGSGSGTDFTLKISRVEAEDLGVYYCFQGSHAPWTFGGGTKLEIK

SEQ ID NO: 3442 - protein, 113 aa, Artificial Sequence
  Description of Artificial Sequence: Synthetic light chain variable domain
DIVMSQSPSSLTVSVGEKGTMSCKSSQSLLYSSNQKNYLAWYQQKPGQSPKLLIYWASTRESGVPDRFTGSGSGTDFSLTISSVLAEDLAVYFCHQYYSSPYTFGGGTKLEIK

SEQ ID NO: 3443 - protein, 108 aa, Artificial Sequence
  Description of Artificial Sequence: Synthetic light chain variable domain
QIVLTQSPAIMSASPGERVTLTCSASSSVSSSFLYWYQQKSGSSPKLWIYSTSTLASGVPARFSGSGSGTSYSLTISSMEAEDAASYFCHQWSSYPWTFGGGTKLEIK

SEQ ID NO: 3444 - protein, 113 aa, Artificial Sequence
  Description of Artificial Sequence: Synthetic light chain variable domain
DIVMTQSPSSLAMSVGQKVTMSCKSSQSLLNSSTQKNYLAWYQQKPGQSPKLLIYFASTRGSGVPDRFIGSGSGTDFTLTISSVQTEDLADYFCQQHYSIPCTFGGGTKLEIK

SEQ ID NO: 3445 - protein, 103 aa, Artificial Sequence
  Description of Artificial Sequence: Synthetic light chain variable domain
DIQMNQSPSSLSASLGDTITITCHVSQNINVWLTWYQQKPGNIPKLLLYKASNLQTGVPSRFSGSGSGTGFTLTISSLQPEDIATYYCQQGQSYPFTFGSGTK

SEQ ID NO: 3446 - protein, 111 aa, Artificial Sequence
  Description of Artificial Sequence: Synthetic light chain variable domain
DIVMSQSPSSLAVSVGEKVTMSCKSSQSLLYSNNQKNYLAWYQQKPGQSPKLLIYWASSRESGVPERFTGSGSGTDFTLTISSVKAEDLAVYYCQQYYSSPYTFGGGTKLK

SEQ ID NO: 3447 - protein, 107 aa, Artificial Sequence
  Description of Artificial Sequence: Synthetic light chain variable domain
DIVMTQSQKFMSTSVGDRVSVTCKASQNVAINVAWYQQKPGQSPKALIYSASYRYSVVPDRFTGSGSGTDFTLPISNVQSEGLADYFCLQYINYPYTFGGGTKLEIK

SEQ ID NO: 3448 - protein, 106 aa, Artificial Sequence
  Description of Artificial Sequence: Synthetic light chain variable domain
QIVLSQSPAILSASPGEKVTMTCRASSSVSYIHWYQQKAGSSPTSWIYATSNLASGVPTRFSGSGSGTSYSLTVNRVEAEDAATYYCQQWSTTPPTFGGGTRLEIK

SEQ ID NO: 3449 - protein, 110 aa, Artificial Sequence
  Description of Artificial Sequence: Synthetic light chain variable domain
DIVMTQSPSSLTVTAGEKVTMSCKSSQSLLKSGNQKNYLTWYQQKPGQPPKLLIYWASTRESGVPDRFTGSGFGTDFTLTISSVQAEDLAVYYCQSDYNYPTFGSGTKLK

SEQ ID NO: 3450 - protein, 106 aa, Artificial Sequence
  Description of Artificial Sequence: Synthetic light chain variable domain
QIVLTQSPAIMSASPGEKVTITCSASSSVSYMHWFQQKPGTSPKLWIYSTSNLASGVPARFSGSGSGTSYSLTISRMEAEDAATYYCQQRSTYPYTFGGGTKLEIK

SEQ ID NO: 3451 - protein, 106 aa, Artificial Sequence
  Description of Artificial Sequence: Synthetic light chain variable domain
QIVLSQSPAILSASPGEKVTMTCRASSSVSYMHWYQQKPGSSPKPWIYAASNLASGVPARFSATGSGTSYSLTISRVEAEDAATYCCQQWSNNPPTFGGGTKLEIK

SEQ ID NO: 3452 - protein, 111 aa, Artificial Sequence
  Description of Artificial Sequence: Synthetic light chain variable domain
DIVLTQSPASLAVSLGQRATISCRANESVEYYGTSLMQWYQQKPGQPPKLLIYAASSVKSGVPARFSGSGSGTDFSLNIHPVEEDDIAMYFCQQSRKVPSTFGGGTKLEIK

SEQ ID NO: 3453 - protein, 111 aa, Artificial Sequence
  Description of Artificial Sequence: Synthetic light chain variable domain
DIVLTQSPASLAVSLGQRATISCRAHESVEYYGTSLMQWYQQKPGQPPKLLIYAASSVKSGVPARFSGSGSGTDFSLNIHPVEEDDIAMYFCQQSRKVPSTFGGGTKLEIK

SEQ ID NO: 3454 - protein, 113 aa, Artificial Sequence
  Description of Artificial Sequence: Synthetic light chain variable domain
DIVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYNYPYTFGGGTKLEIK

SEQ ID NO: 3455 - protein, 109 aa, Artificial Sequence
  Description of Artificial Sequence: Synthetic light chain variable domain
DIVLTQSPASLAVSLGQRATISCRANENVEYYGTSLMQWYQQKPGQPPKLLIYAASNVKSGVPARFSGSGSGTDFSLNIHPVEEDDIAMYFCQQSRKVPSTFGGGTKLK

SEQ ID NO: 3456 - protein, 113 aa, Artificial Sequence
  Description of Artificial Sequence: Synthetic light chain variable domain
DIVMSQSPSSLAVSVGEKVTMSCKSSQSLLYSSNQKNYLAWYQQKPGQSPKLLIYWASTRESGVPDRFTGSGSGTDFTLTISTVKAEDLAVYYCHQYYSYPYTFGGGTKLEIK

SEQ ID NO: 3457 - protein, 111 aa, Artificial Sequence
  Description of Artificial Sequence: Synthetic light chain variable domain
DIVLTQSPGSLAVSLGQRATISCRASQSVSSSSYSYMHWYQQKPGQPPKLLIKFASNLESGVPARFSGSGSGTDFTLNIHPVEEEDTATYYCQHSWEIPLTFGAGTKLELK

SEQ ID NO: 3458 - protein, 107 aa, Artificial Sequence
  Description of Artificial Sequence: Synthetic light chain variable domain
DVQITQSPSYLAASPGETISINCRASKNISKYLAWYQEKPGKTNKLLIYSGSTLQSGIPSGFSGSGSGTDFTLTISSLEPEDFAMYYCQQHFEYPYTFGGGTKLEIK

SEQ ID NO: 3459 - protein, 105 aa, Artificial Sequence
  Description of Artificial Sequence: Synthetic light chain variable domain
QIVLTQSPAIMSASLGEEITLTCSATSSVGYIHWYQQTSGTSPRLLIYTTSNLASGVPSRFSGSGSGTFYSLTISSVEAEDAADYYCHQWSRYPTFGGGTKLEIK

SEQ ID NO: 3460 - protein, 107 aa, Artificial Sequence
  Description of Artificial Sequence: Synthetic light chain variable domain
DIKMTQSPSSTYASLGERVTITCKASQDINTYLYWFQQKPGKPPKTLIYRANRLIDGVPSRFSGSGSGQDYSLTISSLEYEDLGIYYCLQYDEFPYTFGGGTKLEIK

SEQ ID NO: 3461 - protein, 111 aa, Artificial Sequence
  Description of Artificial Sequence: Synthetic light chain variable domain
DIVLTQSPASLAVSLGQRATISCRADESVEYYGTSLMQWYQQKPGQPPKLLIYAASNVKSGVPARFSGSGSGTDFSLNIHPVEEDDIAIYFCQQSREVPSTFGGGTKLEIK

SEQ ID NO: 3462 - protein, 112 aa, Artificial Sequence
  Description of Artificial Sequence: Synthetic light chain variable domain
DIVMTQAAFSNPVTLGTSASISCRSSKSLLHSNGITYLYWYLQKPGQSPQLLIYQMSNLASGVPDRFSNSGSGTDFTLRISRVEAEDVGVYYCAQNLELPWTFGGGTKLEIK

SEQ ID NO: 3463 - protein, 108 aa, Artificial Sequence
  Description of Artificial Sequence: Synthetic light chain variable domain
DIVMTQSHKLMSASVGDRVSITCKASQDVGTAVAWYQQKPGRSPKLLIYWASNRHTGVPDRFTGSGSGTDFTLTISNVQSEDLADYFCQQFGSYPYTFGGGTKLEIKR

SEQ ID NO: 3464 - protein, 111 aa, Artificial Sequence
  Description of Artificial Sequence: Synthetic light chain variable domain
DIVLTQSPLSLLVSLGDQASISCRSSQSLVHSNGNTYLHWYLQKPGQSPNLLIFKVSNRFSGVPDRFSGSGSGTDFTLRISRVEAEDLGVYFCSQTTHVWTFGGGTKLEIK

SEQ ID NO: 3465 - protein, 107 aa, Artificial Sequence
  Description of Artificial Sequence: Synthetic light chain variable domain
DIQMTQSPSSLLAALGERVSLTCRASQEISGYLSWLQQKPDGTIKRLIYAASTLDSGVPKRFSGSESGSDYSLTISSLESEDFADYYCLQYFSYPLTFGAGTKLELK

SEQ ID NO: 3466 - protein, 111 aa, Artificial Sequence
  Description of Artificial Sequence: Synthetic light chain variable domain
DIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIK

SEQ ID NO: 3467 - protein, 108 aa, Artificial Sequence
  Description of Artificial Sequence: Synthetic light chain variable domain
DIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKR

SEQ ID NO: 3468 - protein, 115 aa, Artificial Sequence
  Description of Artificial Sequence: Synthetic light chain variable domain
DIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVS

SEQ ID NO: 3469 - protein, 113 aa, Artificial Sequence
  Description of Artificial Sequence: Synthetic light chain variable domain
NIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKR

SEQ ID NO: 3470 - protein, 112 aa, Artificial Sequence
  Description of Artificial Sequence: Synthetic light chain variable domain
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIK

SEQ ID NO: 3471 - protein, 111 aa, Artificial Sequence; identical to SEQ ID NO: 3466
  Description of Artificial Sequence: Synthetic light chain variable domain

SEQ ID NO: 3472 - protein, 107 aa, Artificial Sequence
  Description of Artificial Sequence: Synthetic light chain variable domain
DIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIK

SEQ ID NO: 3473 - protein, 107 aa, Artificial Sequence
  Description of Artificial Sequence: Synthetic light chain variable domain
ETTLTQSPSSVSASVGDRVSITCRASQDIDTWLAWYQLKPGKAPKLLMYAASNLQGGVPSRFSGSGSGTDFILTISSLQPEDFATYYCQQASIFPPTFGGGTKVDIK

SEQ ID NO: 3474 - protein, 108 aa, Artificial Sequence; identical to SEQ ID NO: 3467
  Description of Artificial Sequence: Synthetic light chain variable domain

SEQ ID NO: 3475 - protein, 112 aa, Artificial Sequence
  Description of Artificial Sequence: Synthetic light chain variable domain
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIK

SEQ ID NO: 3476 - protein, 107 aa, Artificial Sequence
  Description of Artificial Sequence: Synthetic light chain variable domain
DIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIK

SEQ ID NO: 3477 - protein, 115 aa, Artificial Sequence; identical to SEQ ID NO: 3468
  Description of Artificial Sequence: Synthetic light chain variable domain

SEQ ID NO: 3478 - protein, 111 aa, Artificial Sequence
  Description of Artificial Sequence: Synthetic light chain variable domain
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 3479 - protein, 107 aa, Artificial Sequence
  Description of Artificial Sequence: Synthetic light chain variable domain
DIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIK

SEQ ID NO: 3480 - protein, 113 aa, Artificial Sequence; identical to SEQ ID NO: 3469
  Description of Artificial Sequence: Synthetic light chain variable domain

SEQ ID NO: 3481 - protein, 107 aa, Artificial Sequence
  Description of Artificial Sequence: Synthetic light chain variable domain
DIQLTQSPSSLSASVGDRVTITCQASHDISNYLHWYQQKPGKAPKLLIYDASNLETGVPSRFTGSGSGTDFTLTIRSLQPEDVAAYYCQQSDDLPHTFGQGTKVDIK

SEQ ID NO: 3482 - protein, 107 aa, Artificial Sequence
  Description of Artificial Sequence: Synthetic light chain variable domain
DIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 3483 - protein, 108 aa, Artificial Sequence
  Description of Artificial Sequence: Synthetic light chain variable domain
SIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKR

SEQ ID NO: 3484 - protein, 107 aa, Artificial Sequence
  Description of Artificial Sequence: Synthetic light chain variable domain
SIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIK

SEQ ID NO: 3485 - protein, 108 aa, Artificial Sequence
  Description of Artificial Sequence: Synthetic light chain variable domain
QIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELK

SEQ ID NO: 3486 - protein, 108 aa, Artificial Sequence
  Description of Artificial Sequence: Synthetic light chain variable domain
DIQMTQSPASLSVSVGETVTITCRASENIRSNLAWYQQKQGKSPQLLVNVATNLADGVPSRFSGSGSGTQYSLKINSLQSEDFGTYYCQHYWGTTWTFGGGTKLEIKR

SEQ ID NO: 3487 - protein, 108 aa, Artificial Sequence
  Description of Artificial Sequence: Synthetic light chain variable domain
DIQMTQSPSSLSVSVGERVTITCRASENIRSNLAWYQQKPGKSPKLLVNVATNLADGVPSRFSGSGSGTDYSLKINSLQPEDFGTYYCQHYWGTTWTFGQGTKLEIKR

SEQ ID NO: 3488 - protein, 448 aa, Artificial Sequence
  Description of Artificial Sequence: Synthetic light chain variable domain
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 3489 - protein, 214 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3490 - protein, 109 aa, Artificial Sequence
  Description of Artificial Sequence: Synthetic light chain variable domain
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 3491 - protein, 219 aa, Artificial Sequence
  Description of Artificial Sequence: Synthetic light chain variable domain
DIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3492 - protein, 107 aa, Artificial Sequence
  Description of Artificial Sequence: Synthetic light chain variable domain
DIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 3493 - protein, 111 aa, Artificial Sequence
  Description of Artificial Sequence: Synthetic light chain variable domain
DIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIK

SEQ ID NO: 3494 - protein, 112 aa, Artificial Sequence
  Description of Artificial Sequence: Synthetic light chain variable domain
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLWTFGGGTKLEIR

SEQ ID NO: 3495 - protein, 109 aa, Artificial Sequence
  Description of Artificial Sequence: Synthetic light chain variable domain
GIKMTQSPSSMVASLGERVTITCKASQDVNSYLSWFQQKPGKSPKTLIYRANRLVDGVPSRFSGSGSGQDVSLTISSLEVEDMGIVVCLQYDEFPYTFGGGTKLEIKRA

SEQ ID NO: 3496 - protein, 116 aa, Artificial Sequence
  Description of Artificial Sequence: Synthetic light chain variable domain
RCDIQMTQTTSSLSASLGDRVTISCSASQGISNYLNWYQQKPDGTVKLLIYVTSSLHSGVPSRFSGSGSGTDYSLTINNLEPEDIATVYCQQVSKLPWTFGGGTKLEIKRADAAPT

SEQ ID NO: 3497 - protein, 108 aa, Artificial Sequence
  Description of Artificial Sequence: Synthetic light chain variable domain
DIQMTQITSSLSASLGDRVTISCSASQGISNYLNWYQQKPDGTVKLLIYYTSSLHSGVPSRFRGSGSGTNYSLTISNLEPEDIATYYCQQYIKLPWTFGGGTKLEIKR

SEQ ID NO: 3498 - protein, 108 aa, Artificial Sequence
  Description of Artificial Sequence: Synthetic light chain variable domain
GIQMTQTTSSLSASLGDRVTISCSASQGISNYLNWYQQKPDGTVKLLIYYTSSLHSGVPSRFSGSGSGTDYSLTISNLEPEDIATYYCQQYIKLPFTFGSGTKLEIKR

SEQ ID NO: 3499 - protein, 120 aa, Artificial Sequence
  Description of Artificial Sequence: Synthetic light chain variable domain
DIQMTQTPSSLSASLGDRVTISCSASQGISNYLNWYQQKPDGTVKLLIYYTSSLHSGVPSRFSGSGSGTDYSLTISNLEPEDIATYYCQQYIKLPWTFGGGTKLAIKRADAAPTVSIFPP

SEQ ID NO: 3500 - protein, 113 aa, Artificial Sequence
  Description of Artificial Sequence: Synthetic light chain variable domain
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLWTFGGGTKLEIKR

SEQ ID NO: 3501 - protein, 124 aa, Artificial Sequence
  Description of Artificial Sequence: Synthetic light chain variable domain
DIVVTQSPASLAVSLGQRATISCRASESVDNYGISFMNWFQQKPGQPPKLLIYAASNQGSGVPARFSGSGSGSDFSLNIHPMEEDDPAMYFCQQSKEVPFTFGSGTKLEIKRADAAPTVSIFPT

SEQ ID NO: 3502 - protein, 108 aa, Artificial Sequence
  Description of Artificial Sequence: Synthetic light chain variable domain
DIQMTQTTSSLSASLGDRVTISCSASQDINNYLNWYQQKPDGTVKLLIYYTSSLHSGVPSRFSGSGSGTDYSLTISNLEPEDIATYYCQQYIKLPWTFGGGTKLEIKR

SEQ ID NO: 3503 - protein, 113 aa, Artificial Sequence
  Description of Artificial Sequence: Synthetic light chain variable domain
DVLMTQSPLSLPVSLGDQASISCRSSQSIVHSNGNTYLEWYLQKPGQSPKLLIYKVSNRFSGVPDRFSGSGSGTDFTLKISRVEAEDLGVYFCFQGSHVPLTFGAGTKLELKR

SEQ ID NO: 3504 - protein, 108 aa, Artificial Sequence
  Description of Artificial Sequence: Synthetic light chain variable domain
NIVMTQSPKSVSMSVGERVTLSCKASENVNTFVSWFQQKPDQSPKLLIVGASNRYPGVPDRFTGSGSATEFTLTISSVQAEDLADVHCGQSYSYPYTFGGGTKLEIKR

SEQ ID NO: 3505 - protein, 111 aa, Artificial Sequence
  Description of Artificial Sequence: Synthetic light chain variable domain
VMTQSPLSLPVNIGDQASISCKSTKSLLNSDGFTYLDWYLQKPGQSPQLLIYLVSNRFSGVPDRFSGSGSGTDFTLKISRVEAEDLGVYYCFQSNSLPFTFGSGTKLEIKR

SEQ ID NO: 3506 - protein, 108 aa, Artificial Sequence
  Description of Artificial Sequence: Synthetic light chain variable domain
DIKMTQSPSSMYASLGERVTITCKASQDINSYLSWFHQKPGKSPKTLIYRANRLVDGVPSRFSGSGSGQDYSLTISSLEFEDMGIYYCLQYDDFPYTFGGGTKLEIKR

SEQ ID NO: 3507 - protein, 120 aa, Artificial Sequence
  Description of Artificial Sequence: Synthetic light chain variable domain
DIKMTQSPSSMYASLGERVTITCKASQDINSYSGWFQQKPGKSPKTLIYRTNRLVDGVPSRFSGSGSGQDYSLSISSLEYEDMGIYYCLQYDEFPYTFGGGTKLEIKRADAAPTVSIFPT

SEQ ID NO: 3508 - protein, 113 aa, Artificial Sequence
  Description of Artificial Sequence: Synthetic light chain variable domain
DIVMTQAAPSVPVTPGESVSISCRSSKSLLHSNGNTYLYWFLQRPGQSPQLLIYRMSNLASGVPDRFSGSGSGTTFTLRISGVEAEDVGVYYCMQHLEYPCTFGGGTKLEIKR

SEQ ID NO: 3509 - protein, 107 aa, Artificial Sequence
  Description of Artificial Sequence: Synthetic light chain variable domain
QIVLTQSPAIMSASPGEKVTLSCSATSSVTYMHWLQQKPGSSPKPWIYRTSNLASGVPARFRGSGSGTSYSLTISSMEAEDAATYYCQQYHSYPPTFGGGTKLEIKR

SEQ ID NO: 3510 - protein, 108 aa, Artificial Sequence
  Description of Artificial Sequence: Synthetic light chain variable domain
AIQMTQTTSSLSASLGDRVTISCSASQDISNYLNWYQQKPDGTVKLLIYYTSSLHSGVPSRFSGSGSGTDYSLTISNVEPEDVATYYCQQYSELPYTFGGGTKLEINR

SEQ ID NO: 3511 - protein, 108 aa, Artificial Sequence
  Description of Artificial Sequence: Synthetic light chain variable domain
DIVLTQFPAILSVSPGERVSFSCRASQSIGTSLHWYQQRTNGSPRLLMKYASESISGIPSRFSGSGSGTDFTLSINSVESEDIADVVCQQSVSWPLTFGAGTKLELKR

SEQ ID NO: 3512 - protein, 110 aa, Artificial Sequence
  Description of Artificial Sequence: Synthetic light chain variable domain
QSVLTTQPPSVSGAPGQRVTISCTGSSSNIGAGYDVHWYQQLPGTAPKLLIYGNNNRPSGVPDRFSGSKSGTSASLAITGLQAEDEADYYCSSYTSGTWLFGGGTKLTVL

SEQ ID NO: 3513 - protein, 110 aa, Artificial Sequence
  Description of Artificial Sequence: Synthetic light chain variable domain
QSVLTTQPPSVSGAPGQRVTISCTGSSSNIGAGYDVHWYQQLPGTAPKLLIYGDNNRPSGVPDRFSGSKSGTSASLAITGLQAEDEADYYCSSYTSGTWLFGGGTKLTVL

SEQ ID NO: 3514 - protein, 107 aa, Artificial Sequence
  Description of Artificial Sequence: Synthetic light chain variable domain
DIQMTQSPSFLSASVGDRVTITCRASQGISSYLAWYQQKPGKAPKLLIYAASTLQSGVPSSFSGSGSGTEFTLTISSLQPEDFATYYCQQLASYPLTFGGGTKVDIK

SEQ ID NO: 3515 - protein, 110 aa, Artificial Sequence
  Description of Artificial Sequence: Synthetic light chain variable domain
SSELTQDPAVSVALGQTVRITCQGDSLRSYYVSWFQQKPPGQAPVFVMYGQNNRPSGISERFSGSSSGNTASLIITGAQAEDEADYYCHSRDSSGTHLRVFGGGTKLTVL

SEQ ID NO: 3516 - protein, 110 aa, Artificial Sequence
  Description of Artificial Sequence: Synthetic light chain variable domain
QSALTQPPSASATPGQRVTISCSGRTSNIGSNHVYWYQQLPGTAPKLLIYRNNQRPSGVPDRFSGSKSGTSASLAISGLRSEDEADYYCATWDDSLSGEVFGGGTKLTVL

SEQ ID NO: 3517 - protein, 109 aa, Artificial Sequence
  Description of Artificial Sequence: Synthetic light chain variable domain
SSELTQDPAVSVALGQTVRITCQGDSLRSYYASWYQQKPGQAPVLVIYGKNNRPSGIPDRFSGSSSGNTASLTITGAQAEDEADYYCNSRDSSGTHLEVFGGGTKVTVL

SEQ ID NO: 3518 - protein, 107 aa, Artificial Sequence
  Description of Artificial Sequence: Synthetic light chain variable domain
SSELTQDPAVSVALGQTVRITCQGDSLRSYYANWYQQKPGQAPVLVIYGKNNRPSGIPDRFSGSSSGNTASLTITGAQAEDEADYYCHSRDISGNYLFASGTKLTVL

SEQ ID NO: 3519 - protein, 110 aa, Artificial Sequence
  Description of Artificial Sequence: Synthetic light chain variable domain
QSVLTQPPSASGTPGQRVTISCSGSSSNIGSNTVNWSRQLPGTAPKLLIYSNNQRPSGVPDRFSGSKSGTSASLAISGLQSEDEADYYCAAWDDSLNVYVFGTGTKVTVL

SEQ ID NO: 3520 - protein, 107 aa, Artificial Sequence
  Description of Artificial Sequence: Synthetic light chain variable domain
KIVLTQSPSSLSASVGDTVTIACRASRDIRNDLAWYQQKPGKAPKLLIYGASSLQSGVPSRFSGSGSGTEFILTISSLQPEDFATYYCHRLNSYPLTFGGGTKVDIK

SEQ ID NO: 3521 - protein, 111 aa, Artificial Sequence
  Description of Artificial Sequence: Synthetic light chain variable domain
NFMLTQPASLSGSPGQSITISCTGTSSDVGGYNYVSWYQQHPGYAPKLMIYDVSNRPSGVSNRFSGSKSGNTASLTISGLQAEDEADYYCSSYTSSSTPWVFGGGTKLTVL

SEQ ID NO: 3522 - protein, 106 aa, Artificial Sequence
  Description of Artificial Sequence: Synthetic light chain variable domain
SYVLTQDPAVSVALGQTVRITCQGDSLRSYYASWYQQKPGQAPVLVIYGKNNRPSGIPDRFSGSSSGNTASLTITGAQAEDEADYYCNSRDSSGNQFGGGTKLTVL

SEQ ID NO: 3523 - protein, 107 aa, Artificial Sequence
  Description of Artificial Sequence: Synthetic light chain variable domain
SSELTQDPAVSVALGQTVRITCQGDSLRTYYASWYQQRPGQAPILVLYGKNNRPSGIPDRFSGSSSGNTASLTITGAQAEDEADYYCNSRDSSGNHWFGGGTKLTVL

SEQ ID NO: 3524 - protein, 110 aa, Artificial Sequence
  Description of Artificial Sequence: Synthetic light chain variable domain
QSVLTQPASVSGSPGQSITISCTGTGSDVGSYNYVSWYQQNPGKAPKLMIYEVSNRPSGVSNRFSGSKSGNTASLTISGLQAEDEADYYCSSYTTSSTLVFGGGTKVTVL

SEQ ID NO: 3525 - protein, 106 aa, Artificial Sequence
  Description of Artificial Sequence: Synthetic light chain variable domain
SELTQDPAVSVALGQTVRITCQGDSLRSYYASWYQQKPGQAPVLVIYGENSRPSGIPDRFSGSSSGNTASLTITGAQAEDEADYYCNSWDSSGNHWFGGGTKLTVL

SEQ ID NO: 3526 - protein, 107 aa, Artificial Sequence
  Description of Artificial Sequence: Synthetic light chain variable domain
AIRMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKLEIK

SEQ ID NO: 3527 - protein, 111 aa, Artificial Sequence
  Description of Artificial Sequence: Synthetic light chain variable domain
DIVMTQSPLSLPVTPGEPASISCRSSQSLLHSNGYDYLDWYLQKPGQSPQLLIYLGSNRASGVPDRFSGSGSGTDFTLKISRVETEDVGIYYCMQGLQTPSFGQGTKLEIK

SEQ ID NO: 3528 - protein, 109 aa, Artificial Sequence
  Description of Artificial Sequence: Synthetic light chain variable domain
SSELTQDPAVSVALGQTVRITCQGDSLRSYYASWYQQKPGQAPVPVIYGKNNRPSGIPDRFSGSSSGNTASLTITGAQAEDEADYYCNSRDSSSTHRGVFGGGTKLTVL

SEQ ID NO: 3529 - protein, 107 aa, Artificial Sequence
  Description of Artificial Sequence: Synthetic light chain variable domain
DIQLTQSPSSLSASVGDRVTITCRASRSISTYLSWYQQKPGKAPKLLIYDASRLQNGVPSRFSGSGSDTDFTLTISSLQPEDFATYFCQQSYNPPWTFGQGTKLEIK

SEQ ID NO: 3530 - protein, 111 aa, Artificial Sequence
  Description of Artificial Sequence: Synthetic light chain variable domain
QSALTQPASVSGSPGQSITISCTGTSSDVGGYNYVSWYQQHPGKAPKLMIYDVSNRPSGVSNRFSGSKSGNTASLTISGLQAEDEAYYYCSSYTSSSDPWVFGGGTQLTVL

SEQ ID NO: 3531 - protein, 107 aa, Artificial Sequence
  Description of Artificial Sequence: Synthetic light chain variable domain
NIQMTQSPSSLSASVGDRVTITCRAGQPISTYVNWYQHKPGKAPKLLIYGASNLQSGVPSRFSGGGSATDFTLTISSLQPEDFATYYCQQSYSSLLTFGDGTKVEIK

SEQ ID NO: 3532 - protein, 120 aa, Artificial Sequence
  Description of Artificial Sequence: Synthetic light chain variable domain
DIKMTQSPSSMYASLGERVTITCKASQDINSYSGWFQQKPGKSPKTLIYRTNRLVDGVPSRFSGSGSGQDYSLSISSLEVEDMGIYVCLQYDEFPYTFGGGTKLEIKRADAAPTVSIFPT

SEQ ID NO: 3533 - protein, 113 aa, Artificial Sequence
  Description of Artificial Sequence: Synthetic light chain variable domain
DIVMTQAAPSVPVTPGESVSISCRSSKSLLHSNGNTYLVWFLQRPGQSPQLLIYRMSNLASGVPDRFSGSGSGTTFTLRISGVEAEDVGVVVCMQHLEVPCTFGGGTKLEIKR

SEQ ID NO: 3534 - protein, 105 aa, Artificial Sequence
  Description of Artificial Sequence: Synthetic light chain variable domain
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAP

SEQ ID NO: 3535 - protein, 104 aa, Artificial Sequence
  Description of Artificial Sequence: Synthetic light chain variable domain
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKR

SEQ ID NO: 3536 - protein, 107 aa, Artificial Sequence
  Description of Artificial Sequence: Synthetic light chain variable domain
ELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEI

SEQ ID NO: 3537 - protein, 113 aa, Artificial Sequence
  Description of Artificial Sequence: Synthetic light chain variable domain
DIVMTQTPLSLSVTPGQPASISCRSSQSLVHTNGNTYLHWYLQKPGQSPQLLIYMVSNRFSGVPDRFSGSGSGTDFTLKISRVEAEDVGVYYCSQSAHVPPLTFGQGTRLEIK

SEQ ID NO: 3538 - protein, 112 aa, Artificial Sequence
  Description of Artificial Sequence: Synthetic light chain variable domain
DIVMTQTPLSLSVTPGQPASISCRSSQSLVHTNGNSYLHWYLQKPGQSPQLLIYMVSNRFSGVPDRFSGSGSGTDFTLKISRVEAEDVGVYYCSQSTHVPFTFGQGTKLEIK

SEQ ID NO: 3539 - protein, 109 aa, Artificial Sequence
  Description of Artificial Sequence: Synthetic light chain variable domain
EIVLTQSPATLSLSPGERATLSCRASQSVSSYLAWYQQKPGQAPRLLIYDASSRATGIPARFGGSGSGGTDFTLTISSLEPEDFAVYYCQLRSNWPPYTFGQGTKLEIK

SEQ ID NO: 3540 - protein, 112 aa, Artificial Sequence
  Description of Artificial Sequence: Synthetic light chain variable domain
AAYKDIQMTQTTSSLSASLGDRVTISCSASQGISNYLNWYQQKPDGTVKLLIYYTSSLHSGVPSRFSGSGSGTDYSLTISNLEPEDIATYYCQQYSKLPYTFGGGTKLEIKR

SEQ ID NO: 3541 - protein, 108 aa, Artificial Sequence
  Description of Artificial Sequence: Synthetic light chain variable domain
DIELTQSPATLSVTPGDSVSLSCRASQSISNNLHWYQQKSHESPRLLIKSASQSISGIPSRFSGSGSGTDFTLSINSVETEDFGMYFCQQSNSWPYTFGGGTKLEIKR

SEQ ID NO: 3542 - protein, 112 aa, Artificial Sequence
  Description of Artificial Sequence: Synthetic light chain variable domain
DIVMTQSPLSLPVTPGEPASISCRSSQSLLNSNGYNYLDWYLQKPGQSPQFLIYLGSYRASGVPDRFSGSGSGTDFTLRISRVEAEDVGVYYCIQTLQTPFTFGPGTKVDIK

SEQ ID NO: 3543 - protein, 107 aa, Artificial Sequence
  Description of Artificial Sequence: Synthetic light chain variable domain
DIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIK

SEQ ID NO: 3544 - protein, 112 aa, Artificial Sequence
  Description of Artificial Sequence: Synthetic light chain variable domain
DIVLTQSPASLAVSLGQRATISCRASKSVSTSGYSFMHWYQQKPGQPPKLLIYLASNLESGVPARFSGSGSGTDFTLNIHPVEEEDAATYYCQHSREVPWTFGGGTKLEIKR

SEQ ID NO: 3545 - protein, 108 aa, Artificial Sequence
  Description of Artificial Sequence: Synthetic light chain variable domain
DIVMTQTPAIMSASPGEKVTITCSASSSVYYMYWFQQKPGTSPKLWIYSTSNLASGVPVRFSGSGSGTSYSLTISRMEAEDAATYYCQQRRNYPYTFGGGTKLEIKRA

SEQ ID NO: 3546 - protein, 260 aa, Artificial Sequence
  Description of Artificial Sequence: Synthetic light chain variable domain
QGQSGQGQFCPWSYYLIGDCDIGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3547 - protein, 264 aa, Artificial Sequence
  Description of Artificial Sequence: Synthetic light chain variable domain
QGQSGQGQFCPWSYYLIGDCDIGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3548 - protein, 260 aa, Artificial Sequence
  Description of Artificial Sequence: Synthetic light chain variable domain
QGQSGQGNLCTEHSAALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3549 - protein, 264 aa, Artificial Sequence
  Description of Artificial Sequence: Synthetic light chain variable domain
QGQSGQGNLCTEHSAALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3550 - protein, 255 aa, Artificial Sequence
  Description of Artificial Sequence: Synthetic light chain variable domain
QGQSGQGCTEHSFALDCGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3551 - protein, 259 aa, Artificial Sequence
  Description of Artificial Sequence: Synthetic light chain variable domain
QGQSGQGCTEHSFALDCGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3552 - protein, 106 aa, Artificial Sequence
  Description of Artificial Sequence: Synthetic light chain variable domain
DIQMTQSPSSLSASVGDRVTITCSASSSVYYMYWYQQKPGKAPKLLIYSTSNLASGVPSRFSGSGSGTDFTLTISSLQPEDFATYYCQQRRNYPYTFGQGTKLEIK

SEQ ID NO: 3553 - protein, 253 aa, Artificial Sequence
  Description of Artificial Sequence: Synthetic light chain variable domain
QFCPWSYYLIGDCDIGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3554 - protein, 257 aa, Artificial Sequence
  Description of Artificial Sequence: Synthetic light chain variable domain
QFCPWSYYLIGDCDIGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3555 - protein, 253 aa, Artificial Sequence
  Description of Artificial Sequence: Synthetic light chain variable domain
NLCTEHSAALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3556 - protein, 257 aa, Artificial Sequence
  Description of Artificial Sequence: Synthetic light chain variable domain
NLCTEHSAALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3557 - protein, 248 aa, Artificial Sequence
  Description of Artificial Sequence: Synthetic light chain variable domain
CTEHSFALDCGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3558 - protein, 252 aa, Artificial Sequence
  Description of Artificial Sequence: Synthetic light chain variable domain
CTEHSFALDCGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3559 - protein, 253 aa, Artificial Sequence
  Description of Artificial Sequence: Synthetic light chain variable domain
NLCTEHSAALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3560 - protein, 260 aa, Artificial Sequence
  Description of Artificial Sequence: Synthetic light chain variable domain
QGQSGQGNLCTEHSAALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3561 - protein, 257 aa, Artificial Sequence
  Description of Artificial Sequence: Synthetic light chain variable domain
NLCTEHSAALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3562 - protein, 264 aa, Artificial Sequence
  Description of Artificial Sequence: Synthetic light chain variable domain
QGQSGQGNLCTEHSAALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3563 - protein, 106 aa, Artificial Sequence
  Description of Artificial Sequence: Synthetic light chain variable domain
DIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3564 - protein, 253 aa, Artificial Sequence
  Description of Artificial Sequence: Synthetic light chain variable domain
NLCTEHSAALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3565 - protein, 260 aa, Artificial Sequence
  Description of Artificial Sequence: Synthetic light chain variable domain
QGQSGQGNLCTEHSAALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3566 - protein, 257 aa, Artificial Sequence
  Description of Artificial Sequence: Synthetic light chain variable domain
NLCTEHSAALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3567 - protein, 264 aa, Artificial Sequence
  Description of Artificial Sequence: Synthetic light chain variable domain
QGQSGQGNLCTEHSAALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3568 - protein, 248 aa, Artificial Sequence
  Description of Artificial Sequence: Synthetic light chain variable domain
CTEHSFALDCGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3569 - protein, 255 aa, Artificial Sequence
  Description of Artificial Sequence: Synthetic light chain variable domain
QGQSGQGCTEHSFALDCGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3570 - protein, 252 aa, Artificial Sequence
  Description of Artificial Sequence: Synthetic light chain variable domain
CTEHSFALDCGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3571 - protein, 259 aa, Artificial Sequence
  Description of Artificial Sequence: Synthetic light chain variable domain
QGQSGQGCTEHSFALDCGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3572 - protein, 248 aa, Artificial Sequence
  Description of Artificial Sequence: Synthetic light chain variable domain
CTEHSFALDCGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3573 - protein, 255 aa, Artificial Sequence
  Description of Artificial Sequence: Synthetic light chain variable domain
QGQSGQGCTEHSFALDCGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3574 - protein, 252 aa, Artificial Sequence
  Description of Artificial Sequence: Synthetic light chain variable domain
CTEHSFALDCGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3575 - protein, 259 aa, Artificial Sequence
  Description of Artificial Sequence: Synthetic light chain variable domain
QGQSGQGCTEHSFALDCGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3576 - protein, 253 aa, Artificial Sequence
  Description of Artificial Sequence: Synthetic light chain variable domain
NLCTEHSAALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3577 - protein, 260 aa, Artificial Sequence
  Description of Artificial Sequence: Synthetic light chain variable domain
QGQSGQGNLCTEHSAALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3578 - protein, 253 aa, Artificial Sequence
  Description of Artificial Sequence: Synthetic light chain variable domain
NLCTEHSAALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3579 - protein, 260 aa, Artificial Sequence
  Description of Artificial Sequence: Synthetic light chain variable domain
QGQSGQGNLCTEHSAALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3580 - protein, 253 aa, Artificial Sequence
  Description of Artificial Sequence: Synthetic light chain variable domain
NLCTEHSAALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3581 - protein, 260 aa, Artificial Sequence
  Description of Artificial Sequence: Synthetic light chain variable domain
QGQSGQGNLCTEHSAALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3582 - protein, 257 aa, Artificial Sequence
  Description of Artificial Sequence: Synthetic light chain variable domain
NLCTEHSAALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3583 - protein, 264 aa, Artificial Sequence
  Description of Artificial Sequence: Synthetic light chain variable domain
QGQSGQGNLCTEHSAALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3584 - protein, 257 aa, Artificial Sequence
  Description of Artificial Sequence: Synthetic light chain variable domain
NLCTEHSAALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3585 - protein, 264 aa, Artificial Sequence
  Description of Artificial Sequence: Synthetic light chain variable domain
QGQSGQGNLCTEHSAALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3586 - protein, 257 aa, Artificial Sequence
  Description of Artificial Sequence: Synthetic light chain variable domain
NLCTEHSAALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3587 - protein, 264 aa, Artificial Sequence
  Description of Artificial Sequence: Synthetic light chain variable domain
QGQSGQGNLCTEHSAALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3588 - protein, 248 aa, Artificial Sequence
  Description of Artificial Sequence: Synthetic light chain variable domain
CTEHSFALDCGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3589 - protein, 255 aa, Artificial Sequence
  Description of Artificial Sequence: Synthetic light chain variable domain
QGQSGQGCTEHSFALDCGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3590 - protein, 248 aa, Artificial Sequence
  Description of Artificial Sequence: Synthetic light chain variable domain
CTEHSFALDCGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3591 - protein, 255 aa, Artificial Sequence
  Description of Artificial Sequence: Synthetic light chain variable domain
QGQSGQGCTEHSFALDCGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3592 - protein, 248 aa, Artificial Sequence
  Description of Artificial Sequence: Synthetic light chain variable domain
CTEHSFALDCGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3593 - protein, 255 aa, Artificial Sequence
  Description of Artificial Sequence: Synthetic light chain variable domain
QGQSGQGCTEHSFALDCGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3594 - protein, 252 aa, Artificial Sequence
  Description of Artificial Sequence: Synthetic light chain variable domain
CTEHSFALDCGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3595 - protein, 259 aa, Artificial Sequence
  Description of Artificial Sequence: Synthetic light chain variable domain
QGQSGQGCTEHSFALDCGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3596 - protein, 252 aa, Artificial Sequence
  Description of Artificial Sequence: Synthetic light chain variable domain
CTEHSFALDCGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3597 - protein, 259 aa, Artificial Sequence
  Description of Artificial Sequence: Synthetic light chain variable domain
QGQSGQGCTEHSFALDCGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3598 - protein, 252 aa, Artificial Sequence
  Description of Artificial Sequence: Synthetic light chain variable domain
CTEHSFALDCGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3599 - protein, 259 aa, Artificial Sequence
  Description of Artificial Sequence: Synthetic light chain variable domain
QGQSGQGCTEHSFALDCGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3600 - protein, 253 aa, Artificial Sequence
  Description of Artificial Sequence: Synthetic light chain variable domain
QFCPWSYYLIGDCDIGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3601 - protein, 260 aa, Artificial Sequence
  Description of Artificial Sequence: Synthetic light chain variable domain
QGQSGQGQFCPWSYYLIGDCDIGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3602 - protein, 257 aa, Artificial Sequence
  Description of Artificial Sequence: Synthetic light chain variable domain
QFCPWSYYLIGDCDIGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3603 - protein, 264 aa, Artificial Sequence
  Description of Artificial Sequence: Synthetic light chain variable domain
QGQSGQGQFCPWSYYLIGDCDIGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3604 - protein, 253 aa, Artificial Sequence
  Description of Artificial Sequence: Synthetic light chain variable domain
QFCPWSYYLIGDCDIGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3605 - protein, 260 aa, Artificial Sequence
  Description of Artificial Sequence: Synthetic light chain variable domain
QGQSGQGQFCPWSYYLIGDCDIGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3606 - protein, 257 aa, Artificial Sequence
  Description of Artificial Sequence: Synthetic light chain variable domain
QFCPWSYYLIGDCDIGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3607 - protein, 264 aa, Artificial Sequence
  Description of Artificial Sequence: Synthetic light chain variable domain
QGQSGQGQFCPWSYYLIGDCDIGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3608 - protein, 253 aa, Artificial Sequence
  Description of Artificial Sequence: Synthetic light chain variable domain
QFCPWSYYLIGDCDIGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3609 - protein, 260 aa, Artificial Sequence
  Description of Artificial Sequence: Synthetic light chain variable domain
QGQSGQGQFCPWSYYLIGDCDIGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3610 - protein, 257 aa, Artificial Sequence
  Description of Artificial Sequence: Synthetic light chain variable domain
QFCPWSYYLIGDCDIGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3611 - protein, 264 aa, Artificial Sequence
  Description of Artificial Sequence: Synthetic light chain variable domain
QGQSGQGQFCPWSYYLIGDCDIGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3612 - protein, 253 aa, Artificial Sequence
  Description of Artificial Sequence: Synthetic light chain variable domain
QFCPWSYYLIGDCDIGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3613 - protein, 260 aa, Artificial Sequence
  Description of Artificial Sequence: Synthetic light chain variable domain
QGQSGQGQFCPWSYYLIGDCDIGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3614 - protein, 257 aa, Artificial Sequence
  Description of Artificial Sequence: Synthetic light chain variable domain
QFCPWSYYLIGDCDIGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3615 - protein, 264 aa, Artificial Sequence
  Description of Artificial Sequence: Synthetic light chain variable domain
QGQSGQGQFCPWSYYLIGDCDIGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3616 - protein, 253 aa, Artificial Sequence
  Description of Artificial Sequence: Synthetic light chain variable domain
QFCPWSYYLIGDCDIGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3617 - protein, 260 aa, Artificial Sequence
  Description of Artificial Sequence: Synthetic light chain variable domain
QGQSGQGQFCPWSYYLIGDCDIGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3618 - protein, 257 aa, Artificial Sequence
  Description of Artificial Sequence: Synthetic light chain variable domain
QFCPWSYYLIGDCDIGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3619 - protein, 264 aa, Artificial Sequence
  Description of Artificial Sequence: Synthetic light chain variable domain
QGQSGQGQFCPWSYYLIGDCDIGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3620 - protein, 253 aa, Artificial Sequence
  Description of Artificial Sequence: Synthetic light chain variable domain
NLCTEHSFALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3621 - protein, 260 aa, Artificial Sequence
  Description of Artificial Sequence: Synthetic light chain variable domain
QGQSGQGNLCTEHSFALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3622 - protein, 257 aa, Artificial Sequence
  Description of Artificial Sequence: Synthetic light chain variable domain
NLCTEHSFALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3623 - protein, 264 aa, Artificial Sequence
  Description of Artificial Sequence: Synthetic light chain variable domain
QGQSGQGNLCTEHSFALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3624 - protein, 253 aa, Artificial Sequence
  Description of Artificial Sequence: Synthetic light chain variable domain
NLCTEHSFALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3625 - protein, 260 aa, Artificial Sequence
  Description of Artificial Sequence: Synthetic light chain variable domain
QGQSGQGNLCTEHSFALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3626 - protein, 257 aa, Artificial Sequence
  Description of Artificial Sequence: Synthetic light chain variable domain
NLCTEHSFALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3627 - protein, 264 aa, Artificial Sequence
  Description of Artificial Sequence: Synthetic light chain variable domain
QGQSGQGNLCTEHSFALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3628 - protein, 253 aa, Artificial Sequence
  Description of Artificial Sequence: Synthetic light chain variable domain
NLCTEHSFALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3629 - protein, 260 aa, Artificial Sequence
  Description of Artificial Sequence: Synthetic light chain variable domain
QGQSGQGNLCTEHSFALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3630 - protein, 257 aa, Artificial Sequence
  Description of Artificial Sequence: Synthetic light chain variable domain
NLCTEHSFALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3631 - protein, 264 aa, Artificial Sequence
  Description of Artificial Sequence: Synthetic light chain variable domain
QGQSGQGNLCTEHSFALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3632 - protein, 253 aa, Artificial Sequence
  Description of Artificial Sequence: Synthetic light chain variable domain
NLCTEHSFALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3633 - protein, 260 aa, Artificial Sequence
  Description of Artificial Sequence: Synthetic light chain variable domain
QGQSGQGNLCTEHSFALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3634 - protein, 257 aa, Artificial Sequence
  Description of Artificial Sequence: Synthetic light chain variable domain
NLCTEHSFALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3635 - protein, 264 aa, Artificial Sequence
  Description of Artificial Sequence: Synthetic light chain variable domain
QGQSGQGNLCTEHSFALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3636 - protein, 253 aa, Artificial Sequence
  Description of Artificial Sequence: Synthetic light chain variable domain
NLCTEHSFALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3637 - protein, 260 aa, Artificial Sequence
  Description of Artificial Sequence: Synthetic light chain variable domain
QGQSGQGNLCTEHSFALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3638 - protein, 257 aa, Artificial Sequence
  Description of Artificial Sequence: Synthetic light chain variable domain
NLCTEHSFALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3639 - protein, 264 aa, Artificial Sequence
  Description of Artificial Sequence: Synthetic light chain variable domain
QGQSGQGNLCTEHSFALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3640 - protein, 253 aa, Artificial Sequence
  Description of Artificial Sequence: Synthetic light chain variable domain
NLCTEHSFALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3641 - protein, 260 aa, Artificial Sequence
  Description of Artificial Sequence: Synthetic light chain variable domain
QGQSGQGNLCTEHSFALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3642 - protein, 257 aa, Artificial Sequence
  Description of Artificial Sequence: Synthetic light chain variable domain
NLCTEHSFALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3643 - protein, 264 aa, Artificial Sequence
  Description of Artificial Sequence: Synthetic light chain variable domain
QGQSGQGNLCTEHSFALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3644 - protein, 106 aa, Artificial Sequence
  Description of Artificial Sequence: Synthetic light chain variable domain
DIQMTQSPSSLSASVGDRVTITCRASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3645 - protein, 153 aa, Artificial Sequence
  Description of Artificial Sequence: Synthetic light chain variable domain
QGQSGQGQFCPWSYYLIGDCDIGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3646 - protein, 150 aa, Artificial Sequence
  Description of Artificial Sequence: Synthetic light chain variable domain
QFCPWSYYLIGDCDIGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3647 - protein, 157 aa, Artificial Sequence
  Description of Artificial Sequence: Synthetic light chain variable domain
QGQSGQGQFCPWSYYLIGDCDIGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3648 - protein, 146 aa, Artificial Sequence
  Description of Artificial Sequence: Synthetic light chain variable domain
NLCTEHSAALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3649 - protein, 153 aa, Artificial Sequence
  Description of Artificial Sequence: Synthetic light chain variable domain
QGQSGQGNLCTEHSAALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3650 - protein, 150 aa, Artificial Sequence
  Description of Artificial Sequence: Synthetic light chain variable domain
NLCTEHSAALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3651 - protein, 157 aa, Artificial Sequence
  Description of Artificial Sequence: Synthetic light chain variable domain
QGQSGQGNLCTEHSAALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3652 - protein, 141 aa, Artificial Sequence
  Description of Artificial Sequence: Synthetic light chain variable domain
CTEHSFALDCGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3653 - protein, 148 aa, Artificial Sequence
  Description of Artificial Sequence: Synthetic light chain variable domain
QGQSGQGCTEHSFALDCGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3654 - protein, 145 aa, Artificial Sequence
  Description of Artificial Sequence: Synthetic light chain variable domain
CTEHSFALDCGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3655 - protein, 152 aa, Artificial Sequence
  Description of Artificial Sequence: Synthetic light chain variable domain
QGQSGQGCTEHSFALDCGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3656 - protein, 146 aa, Artificial Sequence
  Description of Artificial Sequence: Synthetic light chain variable domain
NLCTEHSAALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3657 - protein, 153 aa, Artificial Sequence
  Description of Artificial Sequence: Synthetic light chain variable domain
QGQSGQGNLCTEHSAALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3658 - protein, 150 aa, Artificial Sequence
  Description of Artificial Sequence: Synthetic light chain variable domain
NLCTEHSAALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3659 - protein, 157 aa, Artificial Sequence
  Description of Artificial Sequence: Synthetic light chain variable domain
QGQSGQGNLCTEHSAALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3660 - protein, 146 aa, Artificial Sequence
  Description of Artificial Sequence: Synthetic light chain variable domain
NLCTEHSAALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3661 - protein, 153 aa, Artificial Sequence
  Description of Artificial Sequence: Synthetic light chain variable domain
QGQSGQGNLCTEHSAALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3662 - protein, 150 aa, Artificial Sequence
  Description of Artificial Sequence: Synthetic light chain variable domain
NLCTEHSAALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3663 - protein, 157 aa, Artificial Sequence
  Description of Artificial Sequence: Synthetic light chain variable domain
QGQSGQGNLCTEHSAALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3664 - protein, 141 aa, Artificial Sequence
  Description of Artificial Sequence: Synthetic light chain variable domain
CTEHSFALDCGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3665 - protein, 148 aa, Artificial Sequence
  Description of Artificial Sequence: Synthetic light chain variable domain
QGQSGQGCTEHSFALDCGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3666 - protein, 145 aa, Artificial Sequence
  Description of Artificial Sequence: Synthetic light chain variable domain
CTEHSFALDCGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3667 - protein, 152 aa, Artificial Sequence
  Description of Artificial Sequence: Synthetic light chain variable domain
QGQSGQGCTEHSFALDCGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3668 - protein, 141 aa, Artificial Sequence
  Description of Artificial Sequence: Synthetic light chain variable domain
CTEHSFALDCGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3669 - protein, 148 aa, Artificial Sequence
  Description of Artificial Sequence: Synthetic light chain variable domain
QGQSGQGCTEHSFALDCGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3670 - protein, 145 aa, Artificial Sequence
  Description of Artificial Sequence: Synthetic light chain variable domain
CTEHSFALDCGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3671 - protein, 152 aa, Artificial Sequence
  Description of Artificial Sequence: Synthetic light chain variable domain
QGQSGQGCTEHSFALDCGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3672 - protein, 146 aa, Artificial Sequence
  Description of Artificial Sequence: Synthetic light chain variable domain
NLCTEHSAALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3673 - protein, 153 aa, Artificial Sequence
  Description of Artificial Sequence: Synthetic light chain variable domain
QGQSGQGNLCTEHSAALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3674 - protein, 146 aa, Artificial Sequence
  Description of Artificial Sequence: Synthetic light chain variable domain
NLCTEHSAALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3675 - protein, 153 aa, Artificial Sequence
  Description of Artificial Sequence: Synthetic light chain variable domain
QGQSGQGNLCTEHSAALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3676 - protein, 146 aa, Artificial Sequence
  Description of Artificial Sequence: Synthetic light chain variable domain
NLCTEHSAALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3677 - protein, 153 aa, Artificial Sequence
  Description of Artificial Sequence: Synthetic light chain variable domain
QGQSGQGNLCTEHSAALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3678 - protein, 150 aa, Artificial Sequence
  Description of Artificial Sequence: Synthetic light chain variable domain
NLCTEHSAALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3679 - protein, 157 aa, Artificial Sequence
  Description of Artificial Sequence: Synthetic light chain variable domain
QGQSGQGNLCTEHSAALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3680 - protein, 150 aa, Artificial Sequence
  Description of Artificial Sequence: Synthetic light chain variable domain
NLCTEHSAALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3681 - protein, 157 aa, Artificial Sequence
  Description of Artificial Sequence: Synthetic light chain variable domain
QGQSGQGNLCTEHSAALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3682 - protein, 150 aa, Artificial Sequence
  Description of Artificial Sequence: Synthetic light chain variable domain
NLCTEHSAALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3683 - protein, 157 aa, Artificial Sequence
  Description of Artificial Sequence: Synthetic light chain variable domain
QGQSGQGNLCTEHSAALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3684 - protein, 141 aa, Artificial Sequence
  Description of Artificial Sequence: Synthetic light chain variable domain
CTEHSFALDCGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3685 - protein, 148 aa, Artificial Sequence
  Description of Artificial Sequence: Synthetic light chain variable domain
QGQSGQGCTEHSFALDCGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3686 - protein, 141 aa, Artificial Sequence
  Description of Artificial Sequence: Synthetic light chain variable domain
CTEHSFALDCGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3687 - protein, 148 aa, Artificial Sequence
  Description of Artificial Sequence: Synthetic light chain variable domain
QGQSGQGCTEHSFALDCGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3688 - protein, 141 aa, Artificial Sequence
  Description of Artificial Sequence: Synthetic light chain variable domain
CTEHSFALDCGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3689 - protein, 148 aa, Artificial Sequence
  Description of Artificial Sequence: Synthetic light chain variable domain
QGQSGQGCTEHSFALDCGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3690 - protein, 145 aa, Artificial Sequence
  Description of Artificial Sequence: Synthetic light chain variable domain
CTEHSFALDCGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3691 - protein, 152 aa, Artificial Sequence
  Description of Artificial Sequence: Synthetic light chain variable domain
QGQSGQGCTEHSFALDCGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3692 - protein, 145 aa, Artificial Sequence
  Description of Artificial Sequence: Synthetic light chain variable domain
CTEHSFALDCGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3693 - protein, 152 aa, Artificial Sequence
  Description of Artificial Sequence: Synthetic light chain variable domain
QGQSGQGCTEHSFALDCGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3694 - protein, 145 aa, Artificial Sequence
  Description of Artificial Sequence: Synthetic light chain variable domain
CTEHSFALDCGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3695 - protein, 152 aa, Artificial Sequence
  Description of Artificial Sequence: Synthetic light chain variable domain
QGQSGQGCTEHSFALDCGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3696 - protein, 146 aa, Artificial Sequence
  Description of Artificial Sequence: Synthetic light chain variable domain
QFCPWSYYLIGDCDIGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3697 - protein, 153 aa, Artificial Sequence
  Description of Artificial Sequence: Synthetic light chain variable domain
QGQSGQGQFCPWSYYLIGDCDIGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3698 - protein, 150 aa, Artificial Sequence
  Description of Artificial Sequence: Synthetic light chain variable domain
QFCPWSYYLIGDCDIGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3699 - protein, 157 aa, Artificial Sequence
  Description of Artificial Sequence: Synthetic light chain variable domain
QGQSGQGQFCPWSYYLIGDCDIGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3700 - protein, 146 aa, Artificial Sequence
  Description of Artificial Sequence: Synthetic light chain variable domain
QFCPWSYYLIGDCDIGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3701 - protein, 153 aa, Artificial Sequence
  Description of Artificial Sequence: Synthetic light chain variable domain
QGQSGQGQFCPWSYYLIGDCDIGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3702 - protein, 150 aa, Artificial Sequence
  Description of Artificial Sequence: Synthetic light chain variable domain
QFCPWSYYLIGDCDIGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3703 - protein, 157 aa, Artificial Sequence
  Description of Artificial Sequence: Synthetic light chain variable domain
QGQSGQGQFCPWSYYLIGDCDIGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3704 - protein, 146 aa, Artificial Sequence
  Description of Artificial Sequence: Synthetic light chain variable domain
QFCPWSYYLIGDCDIGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3705 - protein, 153 aa, Artificial Sequence
  Description of Artificial Sequence: Synthetic light chain variable domain
QGQSGQGQFCPWSYYLIGDCDIGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3706 - protein, 150 aa, Artificial Sequence
  Description of Artificial Sequence: Synthetic light chain variable domain
QFCPWSYYLIGDCDIGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3707 - protein, 157 aa, Artificial Sequence
  Description of Artificial Sequence: Synthetic light chain variable domain
QGQSGQGQFCPWSYYLIGDCDIGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3708 - protein, 146 aa, Artificial Sequence
  Description of Artificial Sequence: Synthetic light chain variable domain
QFCPWSYYLIGDCDIGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3709 - protein, 153 aa, Artificial Sequence
  Description of Artificial Sequence: Synthetic light chain variable domain
QGQSGQGQFCPWSYYLIGDCDIGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3710 - protein, 150 aa, Artificial Sequence
  Description of Artificial Sequence: Synthetic light chain variable domain
QFCPWSYYLIGDCDIGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3711 - protein, 157 aa, Artificial Sequence
  Description of Artificial Sequence: Synthetic light chain variable domain
QGQSGQGQFCPWSYYLIGDCDIGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3712 - protein, 146 aa, Artificial Sequence
  Description of Artificial Sequence: Synthetic light chain variable domain
QFCPWSYYLIGDCDIGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3713 - protein, 153 aa, Artificial Sequence
  Description of Artificial Sequence: Synthetic light chain variable domain
QGQSGQGQFCPWSYYLIGDCDIGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3714 - protein, 150 aa, Artificial Sequence
  Description of Artificial Sequence: Synthetic light chain variable domain
QFCPWSYYLIGDCDIGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3715 - protein, 157 aa, Artificial Sequence
  Description of Artificial Sequence: Synthetic light chain variable domain
QGQSGQGQFCPWSYYLIGDCDIGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3716 - protein, 146 aa, Artificial Sequence
  Description of Artificial Sequence: Synthetic light chain variable domain
NLCTEHSFALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3717 - protein, 153 aa, Artificial Sequence
  Description of Artificial Sequence: Synthetic light chain variable domain
QGQSGQGNLCTEHSFALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3718 - protein, 150 aa, Artificial Sequence
  Description of Artificial Sequence: Synthetic light chain variable domain
NLCTEHSFALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3719 - protein, 157 aa, Artificial Sequence
  Description of Artificial Sequence: Synthetic light chain variable domain
QGQSGQGNLCTEHSFALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3720 - protein, 146 aa, Artificial Sequence
  Description of Artificial Sequence: Synthetic light chain variable domain
NLCTEHSFALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3721 - protein, 153 aa, Artificial Sequence
  Description of Artificial Sequence: Synthetic light chain variable domain
QGQSGQGNLCTEHSFALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3722 - protein, 150 aa, Artificial Sequence
  Description of Artificial Sequence: Synthetic light chain variable domain
NLCTEHSFALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3723 - protein, 157 aa, Artificial Sequence
  Description of Artificial Sequence: Synthetic light chain variable domain
QGQSGQGNLCTEHSFALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3724 - protein, 146 aa, Artificial Sequence
  Description of Artificial Sequence: Synthetic light chain variable domain
NLCTEHSFALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3725 - protein, 153 aa, Artificial Sequence
  Description of Artificial Sequence: Synthetic light chain variable domain
QGQSGQGNLCTEHSFALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3726 - protein, 150 aa, Artificial Sequence
  Description of Artificial Sequence: Synthetic light chain variable domain
NLCTEHSFALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3727 - protein, 157 aa, Artificial Sequence
  Description of Artificial Sequence: Synthetic light chain variable domain
QGQSGQGNLCTEHSFALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3728 - protein, 146 aa, Artificial Sequence
  Description of Artificial Sequence: Synthetic light chain variable domain
NLCTEHSFALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3729 - protein, 153 aa, Artificial Sequence
  Description of Artificial Sequence: Synthetic light chain variable domain
QGQSGQGNLCTEHSFALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3730 - protein, 150 aa, Artificial Sequence
  Description of Artificial Sequence: Synthetic light chain variable domain
NLCTEHSFALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3731 - protein, 157 aa, Artificial Sequence
  Description of Artificial Sequence: Synthetic light chain variable domain
QGQSGQGNLCTEHSFALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3732 - protein, 146 aa, Artificial Sequence
  Description of Artificial Sequence: Synthetic light chain variable domain
NLCTEHSFALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3733 - protein, 153 aa, Artificial Sequence
  Description of Artificial Sequence: Synthetic light chain variable domain
QGQSGQGNLCTEHSFALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3734 - protein, 150 aa, Artificial Sequence
  Description of Artificial Sequence: Synthetic light chain variable domain
NLCTEHSFALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3735 - protein, 157 aa, Artificial Sequence
  Description of Artificial Sequence: Synthetic light chain variable domain
QGQSGQGNLCTEHSFALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3736 - protein, 146 aa, Artificial Sequence
  Description of Artificial Sequence: Synthetic light chain variable domain
NLCTEHSFALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3737 - protein, 153 aa, Artificial Sequence
  Description of Artificial Sequence: Synthetic light chain variable domain
QGQSGQGNLCTEHSFALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3738 - protein, 150 aa, Artificial Sequence
  Description of Artificial Sequence: Synthetic light chain variable domain
NLCTEHSFALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3739 - protein, 157 aa, Artificial Sequence
  Description of Artificial Sequence: Synthetic light chain variable domain
QGQSGQGNLCTEHSFALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 3740 - protein, 107 aa, Artificial Sequence
  Description of Artificial Sequence: Synthetic light chain variable domain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 3741 - protein, 107 aa, Artificial Sequence
  Description of Artificial Sequence: Synthetic light chain variable domain
EIVLTQSPGTLSLSPGERATLSCRASQSVSSYLAWYQQKPGQAPRLLIYGASSRATGIPDRFSGSGSGTDFTLTISRLEPEDFAVYYCQQYGSSPLTFGGGTKVEIK

SEQ ID NO: 3742 - protein, 106 aa, Artificial Sequence
  Description of Artificial Sequence: Synthetic light chain variable domain
AIQLTQSPSSLSASVGDRVTITCRASQGISSALAWYQQKPGKAPKLLIYDASSLESGVPSRFSGSGSGTDFTLTISSLQPEDFATYYCQQFNSYPTFGGGTKVEIK

SEQ ID NO: 3743 - protein, 107 aa, Artificial Sequence
  Description of Artificial Sequence: Synthetic light chain variable domain
AIQLTQSPSSLSASVGDRVTITCRASQGISSALAWYQQKPGKAPKLLIYDASSLESGVPSRFSGSGSGTDFTLTISSLQPEDFATYYCQQFSSYPRTFGQGTKVEIK

SEQ ID NO: 3744 - protein, 107 aa, Artificial Sequence
  Description of Artificial Sequence: Synthetic light chain variable domain
DIQMTQSPSSLSASVGDRVTITCRASQGISSWLAWYQQKPEKAPKSLIYAASSLQSGVPSRFSGSGSGTGFTLTISSLQPEDFATYYCQQYNSYPRTFGQGTKVEIK

SEQ ID NO: 3745 - protein, 107 aa, Artificial Sequence
  Description of Artificial Sequence: Synthetic light chain variable domain
EIVLTQSPATLSLSPGERATLSCRASQGVSSYLAWYQQKPGQAPRLLIYDASNRATGIPARFSGSGPGTDFTLTISSLEPEDFAVYYCQQRSNWHLTFGGGTKVEIK

SEQ ID NO: 3746 - protein, 107 aa, Artificial Sequence
  Description of Artificial Sequence: Synthetic light chain variable domain
EIVLTQSPGTLSLSPGERATLSCRASQSVSSSYLAWYQQKPGQAPRLLIYGASSRATGIPDRFSGSGSGTDFTLTISRLEPEDFAVYYCQHYGSSFTFGPGTKVDIK

SEQ ID NO: 3747 - protein, 107 aa, Artificial Sequence
  Description of Artificial Sequence: Synthetic light chain variable domain
DIQMTQSPSSLSASVGDRVTITCRASQYISSWLAWYQQKPEKAPKSLIYAASSLQSGVPSRFSGSGSGTDFTLTISSLQPEDFATYYCQQYHSYPPTFGQGTRLEIK

SEQ ID NO: 3748 - protein, 106 aa, Artificial Sequence
  Description of Artificial Sequence: Synthetic light chain variable domain
SIVMTQTPKFLLVSAGDRVTITCKASQSVTNDVAWYQQKPGQSPKLLIYYASNRYTGVPDRFTGSGYGTDFTFTISTMQAEDLAVYFCQQDYSSLTFGAGTKLELK

SEQ ID NO: 3749 - protein, 112 aa, Artificial Sequence
  Description of Artificial Sequence: Synthetic light chain variable domain
SIVMTPTPKFLLVSAGDRVTITCKASQSVSNDVAWYQQKPGQSPKLLIYYASTRYTGVPDRFTGSGYGTDFTFTISTVQAEDLAVYFCQQDYSSLTFGAGTKLELKRTVAAP

SEQ ID NO: 3750 - protein, 112 aa, Artificial Sequence
  Description of Artificial Sequence: Synthetic light chain variable domain
DVVMTQTPKFLLVSAGDRVTITCKASQSVSNDVAWYQQKPGQSPKLLIYYASTRYTGVPDRFTGSGYGTDFTFTISTVQAEDLAVYFCQQDYSSLTFGAGTKLELKRTVAAP

SEQ ID NO: 3751 - protein, 106 aa, Artificial Sequence
  Description of Artificial Sequence: Synthetic light chain variable domain
DAVMTQTPKFLLVSAGDRVTITCKASQSVTNDVAWYQQKPGQSPKLLIYYASNRYTGVPDRFTGSGYGTDFTFTISTVQAEDLAVYFCQQDYSSLTFGAGTKLELK

SEQ ID NO: 3752 - protein, 93 aa, Artificial Sequence
  Description of Artificial Sequence: Synthetic light chain variable domain
DVVMTQTPLSLPVSLGDQASISCRSSQSLVHRNGNTYLHWYLQGVPDRFSGSGSGTDFTLKISRVEAEDLGLYFCSQSSHVPPTFGAGTKLEI

SEQ ID NO: 3753 - protein, 112 aa, Artificial Sequence
  Description of Artificial Sequence: Synthetic light chain variable domain
DIQLTQTPLSLPVSLGDQASISCRSSQSLVHRNGNTYLHWYLQKPGQSPKLLIYTVSNRFGVPDRFSGSGSGTDFTLKISRVEAEDLGLYFCSQSSHVPPTFGAGTKLEIKR

SEQ ID NO: 3754 - protein, 113 aa, Artificial Sequence
  Description of Artificial Sequence: Synthetic light chain variable domain
DIQLTQSPLSLPVTLGQPASISCRSSQSLVCHRNGNTYLHWFQQRPGQSPRLLIYTVSNRFGVPDRFSGSGSGTDFTLKISRVEAEDVGVYFCSQSSHVPPTFGAGTRLEIKR

SEQ ID NO: 3755 - protein, 111 aa, Artificial Sequence
  Description of Artificial Sequence: Synthetic light chain variable domain
DVVMTQSPLSLPVTLGQPASISCRSSQSLVHSDGNTYLNWFQQRPGQSPRRLIYKVSNRDSGVPDRFSGSGSGTDFTLKISRVEAEDVGVYYCMQGTHWPFTFGQGTRLEI

SEQ ID NO: 3756 - protein, 113 aa, Artificial Sequence
  Description of Artificial Sequence: Synthetic light chain variable domain
DIQLTQTPLSLPVSLDQPASISCRSSQSLVHRNGNTYLHWYLQRPGQSPKLLIYTVSNRFSGVPDRFSGSGSGTDFTLKISRVEAEDLGVYFCSQSSHVPPTFGAGTKLEIKR

SEQ ID NO: 3757 - protein, 113 aa, Artificial Sequence
  Description of Artificial Sequence: Synthetic light chain variable domain
DIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKR

SEQ ID NO: 3758 - protein, 120 aa, Artificial Sequence; identical to SEQ ID NO: 3008
  Description of Artificial Sequence: Synthetic light chain variable domain

SEQ ID NO: 3759 - protein, 111 aa, Artificial Sequence
  Description of Artificial Sequence: Synthetic light chain variable domain
DVVMTQTPLSLPVSLGDQASISCRSSQSLVHRNGNTYLHWYLQKPGQSPKLLIYTVSNRFSGVPDRFSGSGSGTDFTLKISRVEAEDLGLYFCSQSSHVPPTFGAGTKLEI

SEQ ID NO: 3760 - protein, 112 aa, Artificial Sequence
  Description of Artificial Sequence: Synthetic light chain variable domain
DVVMTQTPLTLSVTIGQPASISCKSSQSLLDSDGKTYLNWLLQRPGQSPKCLIYLVSKLDSGVPDRFTGSGSGTDFTLKISRVEAEDLGVYYCWQGTHFPQTFGGGTKLEIK

SEQ ID NO: 3761 - protein, 112 aa, Artificial Sequence
  Description of Artificial Sequence: Synthetic light chain variable domain
DIVMTQTPLSLPVTPGQPASISCKSSQSLLDSDGKTYLNWLLQKPGQSPQSLIYLVSKLDSGVPDRFSGSGSGTDFTLKISRVEAEDVGVYYCWQGTHFPQTFGQGTKVEIK

SEQ ID NO: 3762 - protein, 112 aa, Artificial Sequence
  Description of Artificial Sequence: Synthetic light chain variable domain
DVVMTQTPLSLPVTPGQPASISCKSSQSLLDSDGKTYLNWLLQKPGQSPQSLIYLVSKLDSGVPDRFSGSGSGTDFTLKISRVEAEDVGVYYCWQGTHFPQTFGQGTKVEIK

SEQ ID NO: 3763 - protein, 111 aa, Artificial Sequence
  Description of Artificial Sequence: Synthetic light chain variable domain
DIQMTQSPSSLSASVGDRVTITCKASQSVDYDGDSFLNWYQQKPGKAPKLLIYAARKLGRGVPSRFSGSGSGTDFTLTISSLQPEDFATYYCQQSNEDPLTFGQGTKVEIK

SEQ ID NO: 3764 - protein, 112 aa, Artificial Sequence
  Description of Artificial Sequence: Synthetic light chain variable domain
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 3765 - protein, 112 aa, Artificial Sequence
  Description of Artificial Sequence: Synthetic light chain variable domain
DIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIK

SEQ ID NO: 3766 - protein, 107 aa, Artificial Sequence
  Description of Artificial Sequence: Synthetic light chain variable domain
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKLELK

SEQ ID NO: 3767 - protein, 112 aa, Artificial Sequence
  Description of Artificial Sequence: Synthetic light chain variable domain
DVVMTQTPLTLSVNIGQPASISCKSSQSLLDTDGKTYLNWLLQRPQGSPNRLIYLVSKLDSGVPDRFTGSGSGTDFTLKISRVEAEDLGIYYCWQGTHFPLTFGAGTKLELK

SEQ ID NO: 3768 - protein, 574 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRMAWGASVNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3769 - protein, 574 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRRAWGASVNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3770 - protein, 574 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRMARGASVNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3771 - protein, 574 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRRARGASVNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3772 - protein, 574 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRGMAWGASVNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3773 - protein, 573 aa, Artificial Sequence
  Description of Artificial Sequence: Synthetic light chain variable domain
VQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRRMAWGASVNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3774 - protein, 574 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRGMARGASVNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3775 - protein, 574 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRGRARGASVNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3776 - protein, 574 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRRGARGASVNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3777 - protein, 574 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAGRAWGASVNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3778 - protein, 574 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRGRAWGASVNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3779 - protein, 573 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARTAWGSSIFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3780 - protein, 573 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARRAWGSSIFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3781 - protein, 573 aa, Artificial Sequence; identical to SEQ ID NO: 3780
  Description of Artificial Sequence: Synthetic light chain variable domain

SEQ ID NO: 3782 - protein, 573 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARRARGSSIFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3783 - protein, 573 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRATAWGSSIFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3784 - protein, 573 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRRTAWGSSIFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3785 - protein, 573 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRATARGSSIFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3786 - protein, 573 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRARARGSSIFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3787 - protein, 573 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRRTARGSSIFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3788 - protein, 573 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGARAWGSSIFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3789 - protein, 573 aa, Artificial Sequence
  Description of Artificial Sequence: Synthetic light chain variable domain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRARAWGSSIFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 3790 - protein, 121 aa, Artificial Sequence
  Description of Artificial Sequence: Synthetic light chain variable domain
EVRLVESGGGLVQGPGSLRLSCAASGFALTDYYMSWVRQSPGKTLEWLGFIANKANGHTTDYSPSVKGRFTISRDNSQTILYLQMNTLRTEDSATYYCARDMGIRWNFDVWGQGTTVTVSS

SEQ ID NO: 3791 - protein, 126 aa, Artificial Sequence
  Description of Artificial Sequence: Synthetic light chain variable domain
EVQLVESGGGVVQPGRSLRLSCSSSGFIFSSYAMYWVRQAPGKGLEWVAIIWDDGSDQHYADSVKGRFTISRDNSKNTLFLQMDSLRPEDTGVYFCARDGGHGFCSSASCFGPDYWGQGTPVTVSS

SEQ ID NO: 3792 - protein, 107 aa, Artificial Sequence
  Description of Artificial Sequence: Synthetic light chain variable domain
DIQLTQSPSSLSASVGDRVTITCQASQDIIKYLNWYQQKPGKAPKLLIYEASNLQAGVPSRFSGSGSGTDFTFTISSLQPEDIATYYCQQYQSLPYTFGQGTKVEIK

SEQ ID NO: 3793 - protein, 107 aa, Artificial Sequence
  Description of Artificial Sequence: Synthetic light chain variable domain
DIQLTQSPSSLSASVGDRVTMTCSASSRVSYIHWYQQKPGKAPKRWIYGTSTLASGVPARFSGSGSGTDFTFTISSLQPEDIATYYCQQWSYNPPTFGQGTKVEIKR

SEQ ID NO: 3794 - protein, 107 aa, Artificial Sequence
  Description of Artificial Sequence: Synthetic light chain variable domain
DIQLTQSPAIMSASPGEKVTMTCSASSRVSYIHWYQQKSGTSPKRWIYGTSTLASGVPARFSGSGSGTSYSLTISSMEAEDAATYYCQQWSYNPPTFGAGTKLELKR

SEQ ID NO: 3795 - protein, 214 aa, Artificial Sequence
  Description of Artificial Sequence: Synthetic light chain variable domain
DIQMTQSPSSVSASVGDRVTITCKASEDIYNRLAWYQQKPGKAPKLLIYGATSLETGVPSRFSGSGSGTDYTLTISSLQPEDFATYYCQQYWSTPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3796 - protein, 217 aa, Artificial Sequence
  Description of Artificial Sequence: Synthetic light chain variable domain
DIVMTQSPDSLAVSLGERATINCRASQTVSTSSYSYMHWYQQKPGQPPKLLIYFASNVESGVPDRFSGSGSGTDFTLTISSLQAEDVAVYYCQHSWEIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 3797 - protein, 215 aa, Artificial Sequence
  Description of Artificial Sequence: Synthetic light chain variable domain
EIVLTQSPATLSLSPGERATLSCSVSSSISSSNLHWYQQKPGQAPRLLIYGTSNLASGIPARFSGSGSGTDFTLTISSLEPEDFAVYYCQQWSSYPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3798 - protein, 214 aa, Artificial Sequence
  Description of Artificial Sequence: Synthetic light chain variable domain
DIQMTQSPSSLSASVGDRVTITCKAGQNVGTSVAWFQQKPGKAPKSLIYSASYRYSGVPSRFSGSGSGTDFTLTISSLQPEDFATYYCQQYITYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3799 - protein, 107 aa, Artificial Sequence
  Description of Artificial Sequence: Synthetic light chain variable domain
DIQMTQSSSSFSVSLGDRVTITCKASEDIYNRLAWYQQKPGNAPRLLISGATSLETGTPSRFSGSGSGKDYTLSITSLRTEDAATYYCQQYWSTPLTFGTGTKLELK

SEQ ID NO: 3800 - protein, 111 aa, Artificial Sequence
  Description of Artificial Sequence: Synthetic light chain variable domain
DIVLTQSPASLAVSLGQRATISCRASQTVSTSSYSYMHWFQQKPGQPPKLLIKFASNVESGVPARFSGSGSGTDFTLNIHPVEEEDISTYYCQHSWEIPWTFGGGTKLEIK

SEQ ID NO: 3801 - protein, 108 aa, Artificial Sequence
  Description of Artificial Sequence: Synthetic light chain variable domain
QIVLTQSPAIMSASLGERVTMTCTASSSVSSSYLHWYQQKPGSSPTLWIYRTSDLASGVPARFSGSGSGTSYSLTISSMEAEDAATYYCHQYHRSPWTFGGGTRLEIK

SEQ ID NO: 3802 - protein, 107 aa, Artificial Sequence
  Description of Artificial Sequence: Synthetic light chain variable domain
DIQMTQSSSSFSVSLGDRVTITCKASEDIYNRLAWYQQKPGNAPRLLISGATSLETGVPSRFSGSGSGKDYTLSITSLQTEDVATYYCQQYWSNPPTFGGGTKLEIK

SEQ ID NO: 3803 - protein, 106 aa, Artificial Sequence
  Description of Artificial Sequence: Synthetic light chain variable domain
DVQMTQSPSSLSASLGERVSLTCQASQSVSNNLNWYQQTPGKAPRLLIYGASKLEDGVSSRFSGTGYGTDFTFTISSLEEEDVATYFCLQHRYLWTFGGGTKLEIK

SEQ ID NO: 3804 - protein, 107 aa, Artificial Sequence
  Description of Artificial Sequence: Synthetic light chain variable domain
DIQMTQSSSSFSVSLGDRVTITCKASEDIYNRLAWYQQKPGNAPRLLICGATSLETGVPSRFSGSGSGKDYTLSITSLQTEDVATYYCQQYWSTPLTFGAGTKLELK

SEQ ID NO: 3805 - protein, 108 aa, Artificial Sequence
  Description of Artificial Sequence: Synthetic light chain variable domain
EIVLTQSPALMAASPGEKVTITCSVSSSISSSNLHWYQQKSGTSPKLWIYGTSNLASGVPVRFSGSGSGTSYSLTISNMEAEDAATYYCQQWSSYPHTFGGGTKLEIK

SEQ ID NO: 3806 - protein, 107 aa, Artificial Sequence
  Description of Artificial Sequence: Synthetic light chain variable domain
DIQMTQSSSSFSVSLGDRVTITCKASEDIYNRLAWYQQKPGNAPRLLISGATSLEAGVPSGFSGSGSGKDYTLSITSLQTEDVATYYCQQYWSTPPTFGGGTKLELK

SEQ ID NO: 3807 - protein, 107 aa, Artificial Sequence
  Description of Artificial Sequence: Synthetic light chain variable domain
DIQMTQSSSSFSVSLGDRVTITCKASEDIYNRLAWYQQNPGNTPRLLMSGATSLETGVPSRFSGSGSGKDYTLSITSLQIEDVSTYYCQQYWSTPPTFGGGTRLEIK

SEQ ID NO: 3808 - protein, 107 aa, Artificial Sequence
  Description of Artificial Sequence: Synthetic light chain variable domain
DIVMTQSQKFMSTSVGDRVSVACKAGQNVGTSVAWYQQKPGHSPKSLIYSASYRYSGVPNRFTGSGSGTDFTLTISNVQSEDLADYFCQQYITYPYTFGGGTKLEII

SEQ ID NO: 3809 - protein, 107 aa, Artificial Sequence
  Description of Artificial Sequence: Synthetic light chain variable domain
DIQMTQSPSSVSASVGDRVTITCKASEDIYNRLAWYQQKPGKAPKLLIYGATSLETGVPSRFSGSGSGTDYTLTISSLQPEDFATYYCQQYWSTPLTFGQGTKLEIK

SEQ ID NO: 3810 - protein, 111 aa, Artificial Sequence
  Description of Artificial Sequence: Synthetic light chain variable domain
DIVMTQSPDSLAVSLGERATINCRASQTVSTSSYSYMHWYQQKPGQPPKLLIYFASNVESGVPDRFSGSGSGTDFTLTISSLQAEDVAVYYCQHSWEIPWTFGQGTKLEIK

SEQ ID NO: 3811 - protein, 108 aa, Artificial Sequence
  Description of Artificial Sequence: Synthetic light chain variable domain
EIVLTQSPATLSLSPGERATLSCSVSSSISSSNLHWYQQKPGQAPRLLIYGTSNLASGIPARFSGSGSGTDFTLTISSLEPEDFAVYYCQQWSSYPHTFGGGTKVEIK

SEQ ID NO: 3812 - protein, 107 aa, Artificial Sequence
  Description of Artificial Sequence: Synthetic light chain variable domain
DIQMTQSPSSLSASVGDRVTITCKAGQNVGTSVAWFQQKPGKAPKSLIYSASYRYSGVPSRFSGSGSGTDFTLTISSLQPEDFATYYCQQYITYPYTFGGGTKVEIK

SEQ ID NO: 3813 - protein, 108 aa, Artificial Sequence
  Description of Artificial Sequence: Synthetic light chain variable domain
EIVLTQSPDFQSVTPKEKVTITCSVSSSISSSNLHWYQQKPDQSPKLWIYGTSNLASGVPSRFSGSGSGTDFTLTINSLEAEDAATYYCQQWSSYPHTFGGGTKVEIK

SEQ ID NO: 3814 - protein, 240 aa, Artificial Sequence
  Description of Artificial Sequence: Synthetic light chain variable domain
MESQTQVLMSLLFWVSGTCGDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3815 - protein, 113 aa, Artificial Sequence
  Description of Artificial Sequence: Synthetic light chain variable domain
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIK

SEQ ID NO: 3816 - protein, 107 aa, Artificial Sequence
  Description of Artificial Sequence: Synthetic light chain variable domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIK

SEQ ID NO: 3817 - protein, 108 aa, Artificial Sequence
  Description of Artificial Sequence: Synthetic light chain variable domain
DIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKR

SEQ ID NO: 3818 - protein, 108 aa, Artificial Sequence
  Description of Artificial Sequence: Synthetic light chain variable domain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVDIK

SEQ ID NO: 3819 - protein, 111 aa, Artificial Sequence
  Description of Artificial Sequence: Synthetic light chain variable domain
TIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIK

SEQ ID NO: 3820 - protein, 107 aa, Artificial Sequence
  Description of Artificial Sequence: Synthetic light chain variable domain
EIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIK

SEQ ID NO: 3821 - protein, 113 aa, Artificial Sequence
  Description of Artificial Sequence: Synthetic light chain variable domain
DIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELK

SEQ ID NO: 3822 - protein, 106 aa, Artificial Sequence
  Description of Artificial Sequence: Synthetic light chain variable domain
DIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIK

SEQ ID NO: 3823 - protein, 108 aa, Artificial Sequence
  Description of Artificial Sequence: Synthetic light chain variable domain
DIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKR

SEQ ID NO: 3824 - protein, 112 aa, Artificial Sequence
  Description of Artificial Sequence: Synthetic light chain variable domain
DIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIK

SEQ ID NO: 3825 - protein, 112 aa, Artificial Sequence
  Description of Artificial Sequence: Synthetic light chain variable domain
NIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKR

SEQ ID NO: 3826 - protein, 106 aa, Artificial Sequence
  Description of Artificial Sequence: Synthetic light chain variable domain
QIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLEL

SEQ ID NO: 3827 - protein, 107 aa, Artificial Sequence
  Description of Artificial Sequence: Synthetic light chain variable domain
ENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLEL

SEQ ID NO: 3828 - protein, 112 aa, Artificial Sequence
  Description of Artificial Sequence: Synthetic light chain variable domain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLDVVFGGGTKLTVL

SEQ ID NO: 3829 - protein, 112 aa, Artificial Sequence
  Description of Artificial Sequence: Synthetic light chain variable domain
EIVLTQSPLSLPVTPGQPASISCRSSQSLVYTDGNTYLNWFQQRPGQSPRRLIYKVSNRDSGVPDRFSGSGSDTDFTLKISRVEAEDVGIYYCMQGTHWSFTFGQGTRLEIK

SEQ ID NO: 3830 - protein, 107 aa, Artificial Sequence
  Description of Artificial Sequence: Synthetic light chain variable domain
DIVMTQSPSSLSASVGDRVTITCRASQGISSYLAWYQQKPGKAPKLLIYAASTLQSGVPSRFSGSGSGTDFTLTISSLQPEDFATYYCQQLNSYPYTFGQGTKLEIK

SEQ ID NO: 3831 - protein, 108 aa, Artificial Sequence
  Description of Artificial Sequence: Synthetic light chain variable domain
EIVLTQSPGTLSLSPGGRATLSCRASQSISGSFLAWYQQKPGQAPRLLIYGASSRATGIPDRFSGSGSGTDFTLTISRLEPEDFAVYYCQQYGSSPPTFGLGTKLEIK

SEQ ID NO: 3832 - protein, 107 aa, Artificial Sequence
  Description of Artificial Sequence: Synthetic light chain variable domain
DIQMTQSPSSLSASIGDRVTITCRASQSISSYLNWYQQKPGKAPKLLIYAASSLQSGVPSRFSGSGSGTDFTLTISSLQPEDFATYYCQQSYSTPWTFGQGTKLEIK

SEQ ID NO: 3833 - protein, 108 aa, Artificial Sequence
  Description of Artificial Sequence: Synthetic light chain variable domain
DIQMTQSPSSLSASVGDRVTITCRASQSISSYLNWYQQKPGKAPKLLMYAASSLQSGVPSRFSGSGSGTDFTLTISSLQPEDFATYYCQQSYSTPPWTFGQGTKVDIK

SEQ ID NO: 3834 - protein, 111 aa, Artificial Sequence
  Description of Artificial Sequence: Synthetic light chain variable domain
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQVVFGGGTKLTVL

SEQ ID NO: 3835 - protein, 107 aa, Artificial Sequence
  Description of Artificial Sequence: Synthetic light chain variable domain
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIK

SEQ ID NO: 3836 - protein, 107 aa, Artificial Sequence
  Description of Artificial Sequence: Synthetic light chain variable domain
DIVMTQSPSSVSASVGDRVTITCRASQDISSWLAWYQQKPGKAPKLLIYAASSLQSGVPSRFNGSGSGTDFTLTISSLQPEDFATYYCQQSYSTPLTFGGGTKVEIK

SEQ ID NO: 3837 - protein, 107 aa, Artificial Sequence
  Description of Artificial Sequence: Synthetic light chain variable domain
DIVLTQSPSSLSASVGDRVTITCQASQDISNYLNWYQQKPGKAPKLLIYDASNLETGVPSRFSGSGSGTDFTFTISSLQPEDFATYYCQQAYSTPFTFGPGTKVEIK

SEQ ID NO: 3838 - protein, 107 aa, Artificial Sequence
  Description of Artificial Sequence: Synthetic light chain variable domain
EIVLTQSPSSLSASVGDRVTITCQASQFIKKNLNWYQHKPGKAPKLLIYDASSLQTGVPSRFSGNRSGTTFSFTISSLQPEDVATYYCQQHDNLPLTFGGGTKVEIK

SEQ ID NO: 3839 - protein, 108 aa, Artificial Sequence
  Description of Artificial Sequence: Synthetic light chain variable domain
DIQVTQSPSSLSASVGDRVTITCRASQSISSYLNWYQQKPGKAPKLLIYAASSLQSGVPSRFSGSGSGTDFTLTISSLQPEDFATYYCQQSYSTPPLTFGQGTKVEIK

SEQ ID NO: 3840 - protein, 107 aa, Artificial Sequence
  Description of Artificial Sequence: Synthetic light chain variable domain
DIQMTQSPSSLSASVGDRVTFTCRASQGISSALAWYQQKPGKPPKLLIYDASSLESGVPSRFSGSGSGTDFTLTISSLQPEDFATYYCQQFNNYPLTFGGGTKVEIK

SEQ ID NO: 3841 - protein, 111 aa, Artificial Sequence
  Description of Artificial Sequence: Synthetic light chain variable domain
DIVLTQSPSSLIVSLGQRATISCRASQSVSTSSYNYMHWYQQKPGQPPKLLLKYASNLESGVPARFSGSGSGTDFTLNIHPVEEEDTATYYCQHSWEIPLTFGAGTKLEIK

SEQ ID NO: 3842 - protein, 111 aa, Artificial Sequence
  Description of Artificial Sequence: Synthetic light chain variable domain
DIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIK

SEQ ID NO: 3843 - protein, 104 aa, Artificial Sequence
  Description of Artificial Sequence: Synthetic light chain variable domain
DIVLTQSPAIMSASPGEKVTMTCSASSSISYMYWYQQKPGTSPKRWIYDTSKLASGVPARFSGSGSGTSYSLTISSMEAEDAATYYCHQRSSWTFGGGTKLEIK

SEQ ID NO: 3844 - protein, 107 aa, Artificial Sequence
  Description of Artificial Sequence: Synthetic light chain variable domain
DIQMTQSHKFMSTSVGDRVSITCKASQDVSTAVAWFQQKPGQSPKLLIYSPSYRYTGVPDRFTGSGSGTDFTFTISSVQAEDLAVYYCQQLYSTPYTFGGGTKLEIK

SEQ ID NO: 3845 - protein, 107 aa, Artificial Sequence
  Description of Artificial Sequence: Synthetic light chain variable domain
DIQMTQSPSSLSASVGDRVTITCKASQDVSTAVAWFQQKPGKAPKLLIYSPSYRYTGVPSRFSGSGSGTDFTLTISSLQPEDFATYYCQQLYSTPYTFGQGTKVEIK

SEQ ID NO: 3846 - protein, 111 aa, Artificial Sequence
  Description of Artificial Sequence: Synthetic light chain variable domain
DIQMTQSPASLAVSLGQRATISCRASQSVSSSSYSYMHWYQQKPGQPPKLLIKYASNLESGVPARFSGRGSGTDFTLNIHPVEEEDTATYYCQHSWEIPYTFGGGTRLEIK

SEQ ID NO: 3847 - protein, 108 aa, Artificial Sequence
  Description of Artificial Sequence: Synthetic light chain variable domain
DIQMTQSPSSLSASVGDRVTLTCRATQELSGYLSWLQQKPGKAIKRLIYAASTLDSGVPSRFSGNRAGTDYTLTISSLQPEDFATYYCLQYAIYPYTFGQGTKLEIKR

SEQ ID NO: 3848 - protein, 108 aa, Artificial Sequence; identical to SEQ ID NO: 3817
  Description of Artificial Sequence: Synthetic light chain variable domain

SEQ ID NO: 3849 - protein, 111 aa, Artificial Sequence; identical to SEQ ID NO: 3819
  Description of Artificial Sequence: Synthetic light chain variable domain

SEQ ID NO: 3850 - protein, 107 aa, Artificial Sequence; identical to SEQ ID NO: 3820
  Description of Artificial Sequence: Synthetic light chain variable domain

SEQ ID NO: 3851 - protein, 112 aa, Artificial Sequence
  Description of Artificial Sequence: Synthetic light chain variable domain
DIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLEL

SEQ ID NO: 3852 - protein, 106 aa, Artificial Sequence; identical to SEQ ID NO: 3822
  Description of Artificial Sequence: Synthetic light chain variable domain

SEQ ID NO: 3853 - protein, 108 aa, Artificial Sequence; identical to SEQ ID NO: 3823
  Description of Artificial Sequence: Synthetic light chain variable domain

SEQ ID NO: 3854 - protein, 112 aa, Artificial Sequence; identical to SEQ ID NO: 3824
  Description of Artificial Sequence: Synthetic light chain variable domain

SEQ ID NO: 3855 - protein, 112 aa, Artificial Sequence; identical to SEQ ID NO: 3825
  Description of Artificial Sequence: Synthetic light chain variable domain

SEQ ID NO: 3856 - protein, 107 aa, Artificial Sequence
  Description of Artificial Sequence: Synthetic light chain variable domain
ETTVTQSPAFLSVATGEKVTIRCITSTDIDDDMNWYQQKPGEPPNVLISEGNTLRPGVPSRFSSSGYGTDFVFTIENTLSEDVADYYCLQSDNMPLTFGAGTKLELK

SEQ ID NO: 3857 - protein, 107 aa, Artificial Sequence
  Description of Artificial Sequence: Synthetic light chain variable domain
ENVLTQSPAIMSASLGEKVTMSCRASSSVNYMSWYQQKSDASPKLWIYYTSNLAPGVPARFSGSGSGNSYSLTISSMEGEDAATYYCQQFTSSPYTFGGGTKLEIKR

SEQ ID NO: 3858 - protein, 107 aa, Artificial Sequence
  Description of Artificial Sequence: Synthetic light chain variable domain
DIQMTQSPSSLSASLGERVSLTCRASQDIGYSLNWLQQEPDGTIKRLIYATSSLDSGVPKRFSGSRSGSDYSLTISSLESEDFVDYYCLQYASSPWTFGGGTKLEIK

SEQ ID NO: 3859 - protein, 107 aa, Artificial Sequence
  Description of Artificial Sequence: Synthetic light chain variable domain
DIKMTQSPSSMYASLGERVTITCKASQDINSYLSWFQQKPGRSPKTLIYRANRLVDGVPSRFSGSGSGQDYSLTISSLDYEDMGIYYCLQYDEFPFTFGSGTKLEIK

SEQ ID NO: 3860 - protein, 113 aa, Artificial Sequence
  Description of Artificial Sequence: Synthetic light chain variable domain
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLYTFGGGTKLKIKR

SEQ ID NO: 3861 - protein, 108 aa, Artificial Sequence
  Description of Artificial Sequence: Synthetic light chain variable domain
ETTVTQSPASLSMAIGEKVTIRCITSTDIDDDMIWYQQKPGEPPKLLISEGNTLRPGVPSRFSSSGYGTDFVFTIENMLSEDVADYYCLKRDDLPYTFGGGTQVEIKR

SEQ ID NO: 3862 - protein, 108 aa, Artificial Sequence
  Description of Artificial Sequence: Synthetic light chain variable domain
QIVLTQSPAIMSASLGERVTLTCTASSSVSSSYLHWYQQKPGSSPKLWIYSTSNLASGVPTRFSGSGSGTSYSLRISSMEAEDAATYYCHQYNRSPLTFGAGTKLELK

SEQ ID NO: 3863 - protein, 106 aa, Artificial Sequence
  Description of Artificial Sequence: Synthetic light chain variable domain
DIQMTQSPSSLSASLGGKVTITCKASQDIKKYIAWYQHKPGKGPRLLIHYTSTLEPGIPSRFSGSGSGRDYSFSISNLEPEDIATYYCLQYDILWTFGGGTKLEIK

SEQ ID NO: 3864 - protein, 108 aa, Artificial Sequence
  Description of Artificial Sequence: Synthetic light chain variable domain
ENVLTQSPAIMAASLGQKVTMTCSASSSVSSSYLHWYQQKSGASPKPLIHRTSNLASGVPARFSGSGSGTSYSLTISSVEAEDDATYYCRQWSGYPWTFGGGTKLEIK

SEQ ID NO: 3865 - protein, 108 aa, Artificial Sequence
  Description of Artificial Sequence: Synthetic light chain variable domain
QIVLTQSPAIMSASLGERVTMTCTASSSVSSSYLHWYQQKPGSSPKLWIYSTSNLASGVPARFSGSESGTSYSLTISNMEAEDAATYYCHQYHRSPFTFGSGTKLEIK

SEQ ID NO: 3866 - protein, 111 aa, Artificial Sequence
  Description of Artificial Sequence: Synthetic light chain variable domain
DIVLTQSPASLAVSLGQRATISCRASKSVSTSGYSYMHWYQQKPGQPPKLLIYLASNLESGVPARFSGSGSGTDFTLNIHPVEEEDAATYYCQHSRELPLTFGAGTKLELK

SEQ ID NO: 3867 - protein, 106 aa, Artificial Sequence
  Description of Artificial Sequence: Synthetic light chain variable domain
QIVLSQSPAILSASPGEKVTMTCRASSSVSYIHWYRQKPGSSPKPWIYATSNLASGVPARFSGSGSGTSYSLTISRVEAEDAATYYCQQWSSNPPTFGAGTKLELK

SEQ ID NO: 3868 - protein, 106 aa, Artificial Sequence
  Description of Artificial Sequence: Synthetic light chain variable domain
DIVMTQSHKFMSTSVGDRVSITKASQDVGTAVAWYQQKPGQSPKLLIYWASIRHTGVPDRFTGSGSGTDFTLTISNVQSEDLADYFCQQYSSYPLTFGAGTKLELK

SEQ ID NO: 3869 - protein, 107 aa, Artificial Sequence
  Description of Artificial Sequence: Synthetic light chain variable domain
DIKMTQSPSSMYASLGERVTITCKASQDINSYLSWFQQKPGKSPKTLIYRANRLVDGVPSRFSGSGSGQDYSLTISSLEYEDMGIYYCLQYDEFPFTFGSGTKLEIK

SEQ ID NO: 3870 - protein, 108 aa, Artificial Sequence
  Description of Artificial Sequence: Synthetic light chain variable domain
DIVMTQSHKFMSTSVGDRVSITCKASQDVNTAVGWYQQKPGQSPKLLIYSASYRYTGVPDRFTGSGSGTDFTFTISSVQAEDLAVYYCQQHYSSPYTFGGGTKLEIKR

SEQ ID NO: 3871 - protein, 108 aa, Artificial Sequence
  Description of Artificial Sequence: Synthetic light chain variable domain
DIQMTQSPASLSASVGETVTITCRASENIYSYLAWYQQKQGKSPQLLVYNAKTLAEGVPSRFSGSRSGSQFSLKINSLQPEDFGSYYCQHHYGTPYTFGGGTKLEIKR

SEQ ID NO: 3872 - protein, 106 aa, Artificial Sequence
  Description of Artificial Sequence: Synthetic light chain variable domain
QIVLTQSPAIMSASPGEKVTMTCSASSSVSYMYWYQQKPGSSPRLLIYDTSNLASGVPVRFSGSGSGTSFSLTISRMEAEDTATYYCQEWSGNPLTFGDGTKLELK

SEQ ID NO: 3873 - protein, 107 aa, Artificial Sequence
  Description of Artificial Sequence: Synthetic light chain variable domain
NIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPPTFGGGTKLEIK

SEQ ID NO: 3874 - protein, 107 aa, Artificial Sequence
  Description of Artificial Sequence: Synthetic light chain variable domain
DIQMTQSPASLAASVGETVTITCRASENIYYSLAWYQQKQGKSPQLLIYNANSLEDGVPSRFSGSGSGTQYSMKINSMQPEDTATYFCKQTYDVPLTFGAGTKLELK

SEQ ID NO: 3875 - protein, 112 aa, Artificial Sequence
  Description of Artificial Sequence: Synthetic light chain variable domain
DVVMTQTPLTLSVTIGQPASISCKSSQSLLDSDGTTYLNWLLQRPGQSPKRLIYLVSKLDSGVPDRFTGSGSGTDFTLKISRVEAEDLGVYYCWQGTHFPLTFGAGTKLELK

SEQ ID NO: 3876 - protein, 107 aa, Artificial Sequence
  Description of Artificial Sequence: Synthetic light chain variable domain
QIVLSQSPAILSASPGEKVTMTCRASSSVSYMHWYQQKPGSSPKPWIYATSNLASGVPARFSGSGSGTSYSLTISRVEAEDAATYYCQQWSSNPYTFGGGTKLEIKR

SEQ ID NO: 3877 - protein, 111 aa, Artificial Sequence
  Description of Artificial Sequence: Synthetic light chain variable domain
DIVMTQSPSSLTVTAGEKVTMSCTSSQSLLTSGNQKNYLTWYQQKPGQPPKLLIYWASTRESGVPDRFTGSGSGTDFTLTISSLQAEDLAVYYCQNDYSLTFGAGTKLELK

SEQ ID NO: 3878 - protein, 107 aa, Artificial Sequence
  Description of Artificial Sequence: Synthetic light chain variable domain
DIQMNQSPSSLSASLGDTITITCHVSQNINVWLSWYQQKPGNIPKLLIQKASNLHTGVPSRFSGSGSGTGFTLTISSLQPEDIATYYCQQGQSYPFTFGSGTKLEIK

SEQ ID NO: 3879 - protein, 112 aa, Artificial Sequence
  Description of Artificial Sequence: Synthetic light chain variable domain
DIVLTQSPASLAVSLGQRATISCKASQSVDYDGDSYLTWYQQKPGQPPKLLIYAASNLESGIPARFSGSGSGTDFTLNIHPVEEEDAATYYCQQSNEDPYTFGGGTKLEIKR

SEQ ID NO: 3880 - protein, 114 aa, Artificial Sequence
  Description of Artificial Sequence: Synthetic light chain variable domain
DIVMSQSPSSLAVSVGEKVTMSCKSSQSLLYSSTQKNYLAWYQQKPGQSPKLLIYWASTRESGVPDRFTGSGSGTDFTLTISSVKAEDLAVYYCQQYYSYPYTFGGGTKLEIKR

SEQ ID NO: 3881 - protein, 107 aa, Artificial Sequence
  Description of Artificial Sequence: Synthetic light chain variable domain
QIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKR

SEQ ID NO: 3882 - protein, 107 aa, Artificial Sequence
  Description of Artificial Sequence: Synthetic light chain variable domain
DIVMTQSQKFMSTSVGDRVSVTCKASQNVGTNVAWYQQKPGQSPKVLIYSASYRYSGVPDRFTGSGSGTDFTLTISNVQSEDLAEFFCQQYNSYPLTFGGGTKLEIK

SEQ ID NO: 3883 - protein, 108 aa, Artificial Sequence
  Description of Artificial Sequence: Synthetic light chain variable domain
QIVLTQSPAIMSASLGERVTMTCTASSSVSSSYLHWYQQKPGSSPKLWIYSTSNLASGVPARFSGSGSGTSYSLTISSMETEDAATYYCHQYHRSPFTFGSGTKLEIK

SEQ ID NO: 3884 - protein, 107 aa, Artificial Sequence
  Description of Artificial Sequence: Synthetic light chain variable domain
DIQMTQSPASQSASLGESVTITCLASQTIGTWLAWYQQKPGKSPQLLISAATSLADGVPSRFSGSGSGTKFSFKISSLQAEDFVSYYCQQLYSTPWTFGGGTKLEIK

SEQ ID NO: 3885 - protein, 107 aa, Artificial Sequence
  Description of Artificial Sequence: Synthetic light chain variable domain
DIQMNQSPSSLSASLGDTITITCHASQNINVWLSWYQQKPGNIPKLLIYKASILHTGVPSRFSGSGSGTGFTLTISSLQPEDIATYSCQQGQSYPYTFGGGTKLEIK

SEQ ID NO: 3886 - protein, 107 aa, Artificial Sequence
  Description of Artificial Sequence: Synthetic light chain variable domain
DIQMNQSPSSLSASLGDTITITCHASQNINVWLSWYQQKPGNIPKLLIYKASNLHTGVPSRFSGSGSGTGFTLTISSLQPEDIATYYCQQGQSYPFTFGSGTKLEIK

SEQ ID NO: 3887 - protein, 108 aa, Artificial Sequence
  Description of Artificial Sequence: Synthetic light chain variable domain
DIQMTQSPASQSASLGESVTITCLASQTIGTWLAWYQQKPGKSPQLLIYAATSLADGVPSRFSGSGSGTKFSFKISSLQAEDFVSYYCQQLYSTPYTFGGGTKLEIKR

SEQ ID NO: 3888 - protein, 107 aa, Artificial Sequence
  Description of Artificial Sequence: Synthetic light chain variable domain
DIQLTQSPASLSASVGETVTITCRASGSIHNYLAWYQQKQGKSPQLLVYNAKTLVDGVPSRFSGSGSGTQYSLKINSLQPEDFGYYYCQHFWTTPWTFGGGTKLEIK

SEQ ID NO: 3889 - protein, 107 aa, Artificial Sequence
  Description of Artificial Sequence: Synthetic light chain variable domain
DIQMTQSPASQSASLGESVTITCLASQTIGTWLAWYQQKPGKSPQLLIYAATSLADGVPSRFSGSGSGTKFSFKISSLQAEDFVSYYCQQLYSTPWTFGGGTKLEIK

SEQ ID NO: 3890 - protein, 107 aa, Artificial Sequence
  Description of Artificial Sequence: Synthetic light chain variable domain
SIVMTQTPKFLLVSAGDRVTITCKASQSVSNDVAWYQQKPGQSPKLLIYCASNRYTGVPDRFTGSGYGTDFTFTISTVQAEDLAVYFCQQDYSSPLTFGAGTKLELK

SEQ ID NO: 3891 - protein, 112 aa, Artificial Sequence
  Description of Artificial Sequence: Synthetic light chain variable domain
DIVLTQSPASLAVSLGQRATISCKASQSVDHAGDSYMNWYQQKPGQPPKLLIYAASNLESGIPARFSGSGSGTDFTLNIHPVEEEDAATYYCQQSNEDPYTFGGGTKLEIKR

SEQ ID NO: 3892 - protein, 107 aa, Artificial Sequence
  Description of Artificial Sequence: Synthetic light chain variable domain
DIKMTQSPSSMYASLGERVTITCKASQDINRYLSWFQQKPGKSPKTLIYRANRLVDGVPSRFSGSGSGQDYSLTISSLEYEDMGIYYCLQYDEFPFTFGSGTKLEIK

SEQ ID NO: 3893 - protein, 107 aa, Artificial Sequence
  Description of Artificial Sequence: Synthetic light chain variable domain
DIQMTQSPASLSASVGETVTITCRASGNIHNYLAWYQQKQGKSPHLLVYNAKTLADGVPSRFSGSGSGTQYSLKINSLQPEDFGSYYCQHFWSTPWTFGGGTKLEIK

SEQ ID NO: 3894 - protein, 106 aa, Artificial Sequence
  Description of Artificial Sequence: Synthetic light chain variable domain
QIVLTQSPAIMSASLGEEITLTCSASSSVSYMHWYQQKSGTSPKLLIYSTSNLASGVPSRFSGSGSGTFYSLTISSVEAEDAADYYCHQWSSYHTFGGGTKLEIKR

SEQ ID NO: 3895 - protein, 107 aa, Artificial Sequence
  Description of Artificial Sequence: Synthetic light chain variable domain
DIQMTQSPASQSASLGESVTITCLASQTIGTWLAWYQQKPGKSPQLLIYSATSLADGVPSRFSGSGSGTKFSFKISSLQAEDFVSYYCQQLYSTPWTFGGGTKLEIK

SEQ ID NO: 3896 - protein, 107 aa, Artificial Sequence
  Description of Artificial Sequence: Synthetic light chain variable domain
DIVMTQSHKFMSTSVGDRVSITCKASQDVNTAVGWYQQKPGQSPKLLIYSASYRYTGVPDRFTGSGSGTDFTFTISSVQAEDLAVYYCQQHYSSPYTFGGGTKLEIK

SEQ ID NO: 3897 - protein, 112 aa, Artificial Sequence
  Description of Artificial Sequence: Synthetic light chain variable domain
DIVLTQSLASLAVSLGQRATISCRASKSVSTSGYSYMHWYQQKPGQPPKLLIYLASNLESGVPARFSGSGSGTDFTLNIHPVEDEDAATYYCQHSRELPFTFGGGTKLEIKR

SEQ ID NO: 3898 - protein, 108 aa, Artificial Sequence
  Description of Artificial Sequence: Synthetic light chain variable domain
DIKMTQSPSSMYASLGERVTITCKASQDINNYLSWFQQKPGKSPKTLIYRANRLVDGVPSRFSGSGSGQDYSLTISSLEYEDMGIYYCLQYDEFPYTFGGGTKLEIKR

SEQ ID NO: 3899 - protein, 112 aa, Artificial Sequence; identical to SEQ ID NO: 3186
  Description of Artificial Sequence: Synthetic light chain variable domain

SEQ ID NO: 3900 - protein, 107 aa, Artificial Sequence
  Description of Artificial Sequence: Synthetic light chain variable domain
SIVMTQTPKFLLVSAGDRVTITCKASQSVSNDVGWYQQKPGQSPKLLIYYASNRYNGVPDRFTGSGYGTDFTFTISTVQAEDLAVYFCQQDYSSPWTFGGGTKLEIK

SEQ ID NO: 3901 - protein, 107 aa, Artificial Sequence
  Description of Artificial Sequence: Synthetic light chain variable domain
DIQMTQTASSLSASLGDRVTISCRASQDINNYLNWYQQKPDGTVKLLIYYTSRLHSGVPSRFSGSGSGTDYSLTISILEQEDIATYFCQQGDTLPWTFGGGTKLEIK

SEQ ID NO: 3902 - protein, 106 aa, Artificial Sequence
  Description of Artificial Sequence: Synthetic light chain variable domain
QIVLTQSPAIMSASPGEKVTMTCSASSSVSYMYWYQQKPGSSPRLLIYDTSNLASGVPVRFSGSGSGTSYSLTISRMEAEDTATYYCQEWSNNPLTFGDGTKLELK

SEQ ID NO: 3903 - protein, 108 aa, Artificial Sequence
  Description of Artificial Sequence: Synthetic light chain variable domain
QIVLTQSPAIMSVSLGERVTMTCTASSSVSSSYLHWYQQKPGSSPKLWIYSTSNLASGVPARFSGSGSGTSYFFTISSMEAEDAATYYCHQYHRSPFTFGAGTKLKIR

SEQ ID NO: 3904 - protein, 107 aa, Artificial Sequence
  Description of Artificial Sequence: Synthetic light chain variable domain
DIQMNQSPSSLSASLGDTITITCHASQNINVWLSWYQQKPGNIPKLLIYKASHLHTGVPSRLSGSGSGTGFTLTISSLQPEDIATYYCQQGQSYPFTFGSGTTLEIK

SEQ ID NO: 3905 - protein, 114 aa, Artificial Sequence
  Description of Artificial Sequence: Synthetic light chain variable domain
DIVMSQSPSSLTVSVGEKVTMSCMSSQSLLYSSTQKNYLAWYQQKPGQSPKLLIYWASTRESGVPDRFTGSGSGTDFTLTISSVKAEDLAVYYCQQYYSYPYTFGGGTKLEIKR

SEQ ID NO: 3906 - protein, 107 aa, Artificial Sequence
  Description of Artificial Sequence: Synthetic light chain variable domain
DIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKR

SEQ ID NO: 3907 - protein, 107 aa, Artificial Sequence
  Description of Artificial Sequence: Synthetic light chain variable domain
AIQLTQSPSSLSASVGDRVTITCRASENIYYNLAWYQQKPGKAPKLLIYTANSLEDGVPSRFSGSGSGTDFTLTISSLQPEDFATYFCKQAYDVPPTFGGGTKLEIK

SEQ ID NO: 3908 - protein, 106 aa, Artificial Sequence
  Description of Artificial Sequence: Synthetic light chain variable domain
EIVLTQSPDFQSVTPKEKVTITCSASSSVSYMHWYQQKPDQSPKLLIKDSSKLASGVPSRFSGSGSGTDFTLTINSLEAEDAATYYCQQWSSNPLTFGQGTKLEIK

SEQ ID NO: 3909 - protein, 107 aa, Artificial Sequence
  Description of Artificial Sequence: Synthetic light chain variable domain
DIQMTQSPSSLSASVGDRVTITCKASQSVSNDVAWYQQKPGKVPKLLIYYASNRYSGVPSRFSGSGSGTDFTLTISSLQPEDVATYFCQQDYSSPWTFGGGTKVEIK

SEQ ID NO: 3910 - protein, 108 aa, Artificial Sequence
  Description of Artificial Sequence: Synthetic light chain variable domain
EIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKR

SEQ ID NO: 3911 - protein, 107 aa, Artificial Sequence
  Description of Artificial Sequence: Synthetic light chain variable domain
DIQMTQTTSSLSASLGDRVTISCRASQDISNYLNWYQQKPDGTVKLLIYYTSRLHSGVPSRFSGSGSGTDYSLTISNLELEDIATYFCQQGDMLPWTFGGGTKLEIK

SEQ ID NO: 3912 - protein, 106 aa, Artificial Sequence
  Description of Artificial Sequence: Synthetic light chain variable domain
QIVLTQSPAIMSASPGEKVTMTCSASSSVSYMHWYQQKSGTSPKRWIYDTSKLASGVPARFSGSGSGTSYSLTISSMEAEDAATYYCQQWTRNPLTFGAGTKLELK

SEQ ID NO: 3913 - protein, 112 aa, Artificial Sequence
  Description of Artificial Sequence: Synthetic light chain variable domain
NIMMTQSPSSLAVSAGEKVTMSCKSSQSVLYSSNQKNYLAWYQQKPGQSPKLLIYWASTRESGVPDRFTGSGSGTDFTLTISTVQVEDLAVYYCHQYLSSWTFGGGTKLEIK

SEQ ID NO: 3914 - protein, 107 aa, Artificial Sequence
  Description of Artificial Sequence: Synthetic light chain variable domain
EIQMTQSPSSMSASLGDRITITCQATQDIVKNLNWYQQKPGKPPSFLIYYAIELAEGVPSRFSGSGSGSDYSLTISNLESEDFADYYCLQFYEFPFTFGAGTKLELK

SEQ ID NO: 3915 - protein, 108 aa, Artificial Sequence
  Description of Artificial Sequence: Synthetic light chain variable domain
QIVLTQSPAIMSASLGERVTMTCTASSSVSSSYLHWYQQKPGSSPKLWIYSTSNLASGVPTRFSGSGSGTSYSLTISSMEAEDAATYYCHQYHRSPFTFGSGTKLEIK

SEQ ID NO: 3916 - protein, 112 aa, Artificial Sequence
  Description of Artificial Sequence: Synthetic light chain variable domain
DVEMTQTPLTLSVTIGQPASISCKSSQSLSDSDGKTYLNWMFQRPGRSPKRLIYLVSKLDSGVPDRFTGSGSGTDFTLKISRVEAEDLGVYYCWQGKHFPWTFGGGTKLEIK

SEQ ID NO: 3917 - protein, 106 aa, Artificial Sequence
  Description of Artificial Sequence: Synthetic light chain variable domain
QIVLTQSPALVSASPGEKVTMTCSASSSVSYMYWYQQKPRSSPKPWIYLTSNLASGVPARFSGSGSGTSYSLTISSMEAEDAATYYCQQWRSNPFTFGSGTKLEIK

SEQ ID NO: 3918 - protein, 107 aa, Artificial Sequence
  Description of Artificial Sequence: Synthetic light chain variable domain
DIQMTQSPASLAASVGETVAITCRASENIYYNLAWYQQKQGKSPQLLIYTANSLEDGVPSRFSGSGSGTQYSLKINSMQPEDSATYFCKQAYDVPPTFGGGTKLEIK

SEQ ID NO: 3919 - protein, 108 aa, Artificial Sequence
  Description of Artificial Sequence: Synthetic light chain variable domain
DIQMTQTTSSLSASLGDRVTISCRASQNIINYLNWYQQKPDGTVKLLIYYTSRLHSGVPSRFSGSGSGTDYSLTISNLEPEDIATYYCQQYSERPYTFGGGTKLEIKR

SEQ ID NO: 3920 - protein, 107 aa, Artificial Sequence
  Description of Artificial Sequence: Synthetic light chain variable domain
DIQMTQSPSSLSASLGGKVTFTCKASQDIHKYVAWYQHKPGKGPRLLIHYTSTLQPGISSRFSGSGSGRDYSFSISNLEPEDIATYYCLQYNNLYTFGGGTKLEIKR

SEQ ID NO: 3921 - protein, 107 aa, Artificial Sequence
  Description of Artificial Sequence: Synthetic light chain variable domain
EIQMTQSPSSMSASLGDRITITCQATQDIVKNLNWYQQKPGKPPSFLIYYATELAEGVPSRFSGSGSGSDYSLTIRNLESEDFADHYCLQFYEFPFTFGAGTKLELK

SEQ ID NO: 3922 - protein, 113 aa, Artificial Sequence
  Description of Artificial Sequence: Synthetic light chain variable domain
DIVMTQSPSSLAMSVGQKVTMSCKSSQSLLNSSNQKNYLAWYQQEPGQSPKLLVSFASTRESGVPDRFTGSGSGTDFTLTISGVQAEDLAVYYCQQHYSIPLTFGAGTKLELK

SEQ ID NO: 3923 - protein, 105 aa, Artificial Sequence
  Description of Artificial Sequence: Synthetic light chain variable domain
DIQMTQTTSSLSASLGDRVTISCRASQDIKNYLNWYQQKPDGTVKPLIYYTSRVHSGVPSRFSGSGSGTDYSLTISNLEQEDIATYFCQQGYTLPFTFGSGTKLE

SEQ ID NO: 3924 - protein, 108 aa, Artificial Sequence
  Description of Artificial Sequence: Synthetic light chain variable domain
QIVLTQSPAIMSASPGEKVTLTCSASSSVSSRYLYWYQQKPGSSPKLWIYSTSNLASGVPARFSGSGSGTSYSLIISSMEAEDAASYFCHQWSNYPLTFGAGTKLELK

SEQ ID NO: 3925 - protein, 106 aa, Artificial Sequence
  Description of Artificial Sequence: Synthetic light chain variable domain
QIVLTQSPAIMSASPGEKVTMTCSASSSVSYMHWYQQKSGTSPKRWIYDSSKLASGVPARFSGSGSGTSYSLTISSMEAEDAATYYCQQWSSNPLTFGAGTKLELK

SEQ ID NO: 3926 - protein, 106 aa, Artificial Sequence
  Description of Artificial Sequence: Synthetic light chain variable domain
QIVLTQSPAIMSASPGEKVTITCSASSSVSYMHWFQQKPGTSPKLWIYTTSNLASGVPARFSGSGSGTSYSLTVSRMEAEDAATYYCQQRSLYPYTFGGGTKVEIK

SEQ ID NO: 3927 - protein, 108 aa, Artificial Sequence
  Description of Artificial Sequence: Synthetic light chain variable domain
QIVLTQSPTIMSASLGERVTMTCTASSSVTSSYLHWYQQKPGSSPKLWIYSTSNLASGVPARFSGSGSGTSYSLTISSMEAEDAATYYCHQFHRSPFTFGSGTKLEIK

SEQ ID NO: 3928 - protein, 112 aa, Artificial Sequence
  Description of Artificial Sequence: Synthetic light chain variable domain
DIVLTQSPLSLPVNIGDQASISCKSTKSLLNSDGFTYLDWYLQRPGQSPQFLIYLVSNRFSGVPDRFSGSGSGTDFTLKISRVEAEDLGVYYCFQSNYLPLTFGAGTKLELR

SEQ ID NO: 3929 - protein, 107 aa, Artificial Sequence
  Description of Artificial Sequence: Synthetic light chain variable domain
SIVMTQTPKFLLVSAGDRVTITCKASQSVSNDVAWYQQKPGQSPKLLIYYASNRYSGVPDRFTGSGYGTDFTFTISTVQAEDLAVYFCQQDYSSPWTFGGGTKLEIK

SEQ ID NO: 3930 - protein, 107 aa, Artificial Sequence
  Description of Artificial Sequence: Synthetic light chain variable domain
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPYTFGGGTKLEIK

SEQ ID NO: 3931 - protein, 107 aa, Artificial Sequence
  Description of Artificial Sequence: Synthetic light chain variable domain
ETTVTQSPASLSVTTGEKVTIRCITTPDIDDDMNWYQQKPGEPPNLLISEGNSLRPGVPSRFSSSGYGTNFVFTIENTLSEDVADYYCLQSDNMPFTFGSGTKLEIK

SEQ ID NO: 3932 - protein, 104 aa, Artificial Sequence
  Description of Artificial Sequence: Synthetic light chain variable domain
QIVLTQSPAIMSASPGEKVTMTCSASSSINYMHWYQQKPGTSPKRWIYDTSKLASGVPARFSGSGSGTSYSLTISSMEAEDAATYYCHQRSTWTFGGGTKLEIK

SEQ ID NO: 3933 - protein, 108 aa, Artificial Sequence
  Description of Artificial Sequence: Synthetic light chain variable domain
DIQMTQTTSSLSASLGDRVTISCRASQDVINYLNWYQQKPDGTVKLLIYYTSRLHSGVPSRFSGSGSRTDYSLTISNLEPEDIATYYCQQYSERPYTFGGGTKLEIKR

SEQ ID NO: 3934 - protein, 112 aa, Artificial Sequence
  Description of Artificial Sequence: Synthetic light chain variable domain
DVLMTQSPLSLSVSLGDQASISCRSSQNIVHSDRYTYLEWYLQKPGQSPKLLIYGVSNRFSGVPDRFSGSGSGTDFTLKISRVEAEDMGVYYCFQGTHVPYTFGGGTKLEIK

SEQ ID NO: 3935 - protein, 107 aa, Artificial Sequence
  Description of Artificial Sequence: Synthetic light chain variable domain
EIQMTQSPSSMSASLGDRITITCQATQDIVKNLNWYQQKPGKPPSFLIYYATELAEGVPARFSGSGSGSDYSLTISNLESEDFADYHCLQFYEFPFTFGAGTKLELK

SEQ ID NO: 3936 - protein, 112 aa, Artificial Sequence
  Description of Artificial Sequence: Synthetic light chain variable domain
DVVLTQSPLSLPVNIGDQASISCKSTKSLLNSDGFTYLDWYLQRPGQSPQFLIYLVSNRFSGVPDRFSGSGSGTDFTLKISRVEAEDLGVYYCFQSNYLPLTFGAGTKLELR

SEQ ID NO: 3937 - protein, 107 aa, Artificial Sequence
  Description of Artificial Sequence: Synthetic light chain variable domain
DIKMTQSPSSMYASLGERVTITCKASQDINSYLSWFQQKPGKSPKTLIYRANRLVDGVPSRFSGSGSGQDYSLTITSLEYEDMGIYYCLQYDEFPLTFGAGTKLELK

SEQ ID NO: 3938 - protein, 106 aa, Artificial Sequence
  Description of Artificial Sequence: Synthetic light chain variable domain
DIQMTQTTSSLSASLGDRVTISCRASQDISNYLNWYQQKPDGTVKLLIYYTSRLHSGVPSRFSGSGSGTDYSLTISNLEQEDIATYFCQQGNTLRTFGGGTKLEIK

SEQ ID NO: 3939 - protein, 107 aa, Artificial Sequence
  Description of Artificial Sequence: Synthetic light chain variable domain
DIQMIQSPSSMFASLGDRVSLSCRASQGIRGTLDWYQQKPNGTIKLLIYSTSNLNSGVPSRFSGSGSGSDYSLTISSLESEDFADYYCLQRNAYPLTFGAGTKLELK

SEQ ID NO: 3940 - protein, 108 aa, Artificial Sequence
  Description of Artificial Sequence: Synthetic light chain variable domain
DIKMTQSPSSMYASLGERVTITCKASQDINSYLNWFQQKPGKSPKTLIYRANRLVDGVPSRFSGSGSGQDYSLTISSLEYEDMGIYYCLQYDEFPYTFGGGTKLEIKR

SEQ ID NO: 3941 - protein, 107 aa, Artificial Sequence
  Description of Artificial Sequence: Synthetic light chain variable domain
SIVMTQTPKFLLVSAGDRVTITCKASQSVSNDVVWYQQKPGQSPKLLIYYASNRYTGVPDRFAGSGYGTDFSFTISTVQAEDLAVYFCQQDYTSPWTFGGGTKLEIR

SEQ ID NO: 3942 - protein, 107 aa, Artificial Sequence
  Description of Artificial Sequence: Synthetic light chain variable domain
DIVMTQSHKFMSISVGDRVSITCKASQDVSIFVAWYQQKPGQSPKLLIYSASYRYTGVPDRFTGSGSGTDFIFTISSVQAEDLAVYYCQQHYGTPFTFGSGTKLKIR

SEQ ID NO: 3943 - protein, 107 aa, Artificial Sequence
  Description of Artificial Sequence: Synthetic light chain variable domain
DIQMTQSPASLSSSVGETVTITCRASENIYSYLAWYQQKQGKSPQLLVYNAKTLAEGVPSRFSGSGSGTQFSLKINSLQPEDFGTYYCQHHYDSPLTFGAGTKLELR

SEQ ID NO: 3944 - protein, 113 aa, Artificial Sequence
  Description of Artificial Sequence: Synthetic light chain variable domain
DIVMTQSTSSLAMSVGQKVTMSCKSSQSLLNSSNQKNYLAWYQQEPGQSPKLLVSFASTRESGVPDRFTGSGSGTDFTLTISGVQAEDLAVYYCQQHYSIPLTFGAGTKLELK

SEQ ID NO: 3945 - protein, 108 aa, Artificial Sequence
  Description of Artificial Sequence: Synthetic light chain variable domain
DIKMTQSPSSMYASLGERVTITCKASQDINSFLSWFQRKPGKSPKTLIYRANRLVDGVPSRFTGSGSGQEFSLTISSLEYEDLGIYYCLQYDEFPYTFGGGTKLEIKR

SEQ ID NO: 3946 - protein, 106 aa, Artificial Sequence
  Description of Artificial Sequence: Synthetic light chain variable domain
QIVLTQSPAIMSASPGEKVTMTCSASSSVSYMYWYQQKSGTSPKRWIYDTSKLASGVPARFSGSGSGTSYSLTISSMEAEDAATYYCQQWSSNPYTFGGGTKLEIK

SEQ ID NO: 3947 - protein, 106 aa, Artificial Sequence
  Description of Artificial Sequence: Synthetic light chain variable domain
QIVLTQSPALMSASPGEKVTMTCSVTSSVSYMYWYQQKPRSSPKPWIYLTSNLASGVPARFSGSGSGTSYSLTISSVEAEDAATYYCQQWRNNPFTFGSGTKVEIK

SEQ ID NO: 3948 - protein, 109 aa, Artificial Sequence
  Description of Artificial Sequence: Synthetic light chain variable domain
QAVVTQESALTTSPGETVTLTCRSSTGAVTTSNYANWIQEKPDHLFTGLIGGTNNRAPGVPARFSGSLIGDKAALTITGAQTEDEAIYFCGLWYSNHLVFGGGTKLTVL

SEQ ID NO: 3949 - protein, 112 aa, Artificial Sequence
  Description of Artificial Sequence: Synthetic light chain variable domain
DIVMTQTPLSLPVTLGEPASISCRSSQSIVHSNGNTYLEWYLQKPGQSPQLLIYKVSNRFSGVPDRFSGSGSGTDFTLKISRVEAEDVGVYYCFQGSHVPWTFGQGTKVEIK

SEQ ID NO: 3950 - protein, 112 aa, Artificial Sequence
  Description of Artificial Sequence: Synthetic light chain variable domain
DIVMTQTPLSLPVTLGEPASISCRSSQSIVSSWGNTYLEWYLQKPGQSPQLLIYKVSNRFSGVPDRFSGSGSGTDFTLKISRVEAEDVGVYYCFQGSHVPWTFGQGTKVEIK

SEQ ID NO: 3951 - protein, 112 aa, Artificial Sequence
  Description of Artificial Sequence: Synthetic light chain variable domain
DIVMTQTPLSLPVTPGEPASISCRSSQSIVSSWGNTYLEWYLQKPGQSPQLLIYKVSNRFSGVPDRFSGSGSGTDFTLKISRVEAEDVGVYYCFQGSHVPWTFGQGTKVEIK

SEQ ID NO: 3952 - protein, 113 aa, Artificial Sequence
  Description of Artificial Sequence: Synthetic light chain variable domain
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQDHSYPYTFGQGTKLEIK

SEQ ID NO: 3953 - protein, 113 aa, Artificial Sequence
  Description of Artificial Sequence: Synthetic light chain variable domain
DIVMTQSPDSLAVSAGERATINCKSSQSLLNSGNQKNYLAWYQQKPGQPPKLLIYGASTRESGVPDRFSGSGSGTDFTLIISSLQAEDVAVYYCQNDHQYPYTFGQGTKLEIK

SEQ ID NO: 3954 - protein, 113 aa, Artificial Sequence
  Description of Artificial Sequence: Synthetic light chain variable domain
DIVMTQSPDSLAVSAGERATINCKSSQSLLNWYNQKNYLAWYQQKPGQPPKLLIYGASTRESGVPDRFSGSGSGTDFTLTISSLQAEDVAVYYCQNDHQYPYTFGQGTKLEIK

SEQ ID NO: 3955 - protein, 113 aa, Artificial Sequence
  Description of Artificial Sequence: Synthetic light chain variable domain
DIVMTQSPDSLAVSLGERATINCKSSQSLLNWYNQKNYLAWYQQKPGQPPKLLIYGASTRESGVPDRFSGSGSGTDFTLTISSLQAEDVAVYYCQNDHQYPYTFGQGTKLEIK

SEQ ID NO: 3956 - protein, 112 aa, Artificial Sequence
  Description of Artificial Sequence: Synthetic light chain variable domain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPWTFGGGTKLEIK

SEQ ID NO: 3957 - protein, 112 aa, Artificial Sequence
  Description of Artificial Sequence: Synthetic light chain variable domain
DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQGSHVPWTFGQGTKVEI

SEQ ID NO: 3958 - protein, 107 aa, Artificial Sequence
  Description of Artificial Sequence: Synthetic light chain variable domain
DIVMTQSHKFMSTSVGDRVSITCKASQDVGIAVAWYQQKPGQSPKLLIYWASTRHTGVPDRFTGSGSGTDFTLTISNVQSEDLADYFCQQYSSYPYTFGGGTKLEIK

SEQ ID NO: 3959 - protein, 107 aa, Artificial Sequence
  Description of Artificial Sequence: Synthetic light chain variable domain
DIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELK

SEQ ID NO: 3960 - protein, 107 aa, Artificial Sequence
  Description of Artificial Sequence: Synthetic light chain variable domain
DIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIK

SEQ ID NO: 3961 - protein, 107 aa, Artificial Sequence; identical to SEQ ID NO: 3958
  Description of Artificial Sequence: Synthetic light chain variable domain

SEQ ID NO: 3962 - protein, 107 aa, Artificial Sequence; identical to SEQ ID NO: 3959
  Description of Artificial Sequence: Synthetic light chain variable domain

SEQ ID NO: 3963 - protein, 107 aa, Artificial Sequence; identical to SEQ ID NO: 3960
  Description of Artificial Sequence: Synthetic light chain variable domain

SEQ ID NO: 3964 - protein, 107 aa, Artificial Sequence
  Description of Artificial Sequence: Synthetic light chain variable domain
ETTVTQSPASLSMAIGEKVTIRCITSTDIDDDMNWYQQKPGEPPKLLISEGNTLRPGVPSRFSSSGYGTDFVFTIENMLSEDVADYYCLQSDNLPLTFGGGTKLEIK

SEQ ID NO: 3965 - protein, 108 aa, Artificial Sequence
  Description of Artificial Sequence: Synthetic light chain variable domain
DIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIK

SEQ ID NO: 3966 - protein, 107 aa, Artificial Sequence; identical to SEQ ID NO: 3958
  Description of Artificial Sequence: Synthetic light chain variable domain

SEQ ID NO: 3967 - protein, 107 aa, Artificial Sequence; identical to SEQ ID NO: 3959
  Description of Artificial Sequence: Synthetic light chain variable domain

SEQ ID NO: 3968 - protein, 107 aa, Artificial Sequence; identical to SEQ ID NO: 3960
  Description of Artificial Sequence: Synthetic light chain variable domain

SEQ ID NO: 3969 - protein, 107 aa, Artificial Sequence; identical to SEQ ID NO: 3964
  Description of Artificial Sequence: Synthetic light chain variable domain

SEQ ID NO: 3970 - protein, 108 aa, Artificial Sequence; identical to SEQ ID NO: 3965
  Description of Artificial Sequence: Synthetic light chain variable domain

SEQ ID NO: 3971 - protein, 234 aa, Artificial Sequence
  Description of Artificial Sequence: Synthetic light chain variable domain
MEAPAQLLFLLLLWLPDTTGEIVMTQSPATLSVSPGERATLSCRASQSVSSNLAWYQQKPGQAPRLLIYGASTRASGIPDRISGSGSGTEFTLIISSLQSEDFAVYYCQQSNNWPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3972 - protein, 232 aa, Artificial Sequence
  Description of Artificial Sequence: Synthetic light chain variable domain
PAQLLFLLLLWLPDTTGEFVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3973 - protein, 232 aa, Artificial Sequence
  Description of Artificial Sequence: Synthetic light chain variable domain
PAQLLFLLLLWLPDTTGEFVLTQSPGTLSLSPGERATLSCRASQSVSSSYLAWYQQKPGQAPRLLIYGASSRATGIPDRFSGSGSGTDFTLTISRLEPEDFVVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3974 - protein, 236 aa, Artificial Sequence
  Description of Artificial Sequence: Synthetic light chain variable domain
MDMRVPAQLLGLLLLWLRGARCDIQMTQSPSSLSASVGDRVTITCRASQSISGFLIWYQQRPGKAPKLLIYATSSLQSGVPLRFSGSESGTDFTLTISSLQPEDFATYYCQQSYSTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3975 - protein, 232 aa, Artificial Sequence
  Description of Artificial Sequence: Synthetic light chain variable domain
PAQLLFLLLLWLPDTTGEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3976 - protein, 108 aa, Artificial Sequence
  Description of Artificial Sequence: Synthetic light chain variable domain
EIELTQSPATLSLSPGERATLSCRASQSVSSYLAWYQQKPGQAPRLLIYDASNRATGIPARFSGSGSGTDFTLTISSLEPEDFAVYYCQQRSNWPPAFGGGTKVEIKR

SEQ ID NO: 3977 - protein, 106 aa, Artificial Sequence
  Description of Artificial Sequence: Synthetic light chain variable domain
QIVLTQSPAILSLSPGERATMSCSASSSVTYMHWFQQKPGKAPKLWIYSTSILASGVPARFSGSGSGTSYTLTISRLEAEDFATYYCQQRTSYPLTFGQGTKLEIK

SEQ ID NO: 3978 - protein, 106 aa, Artificial Sequence
  Description of Artificial Sequence: Synthetic light chain variable domain
QIVLTQSPATLSLSPGERATLSCSASSSVTYMHWFQQKPGKAPKLWIYSTSILASGVPARFSGSGSGTSYTLTISRLEAEDFATYYCQQRTSYPLTFGQGTKLEIK

SEQ ID NO: 3979 - protein, 106 aa, Artificial Sequence
  Description of Artificial Sequence: Synthetic light chain variable domain
EIVLTQSPATLSLSPGERATLSCSASSSVTYMHWFQQKPGKAPKLWIYSTSILASGVPARFSGSGSGTDYTLTISRLEAEDFATYYCQQRTSYPLTFGQGTKLEIK

SEQ ID NO: 3980 - protein, 106 aa, Artificial Sequence
  Description of Artificial Sequence: Synthetic light chain variable domain
EIVLTQSPATLSLSPGERATLSCSASSSVTYMHWFQQKPGKAPKLWIYSTSILASGVPARFSGSGSGTDYTLTISRLEPEDFATYYCQQRTSYPLTFGQGTKLEIK

SEQ ID NO: 3981 - protein, 106 aa, Artificial Sequence
  Description of Artificial Sequence: Synthetic light chain variable domain
EIVLTQSPATLSLSPGERATMSCSASSSVTYMHWFQQKPGKAPKLLIYSTSILASGVPARFSGSGSGTDYTLTISRLEPEDFATYYCQQRTSYPLTFGQGTKLEIK

SEQ ID NO: 3982 - protein, 107 aa, Artificial Sequence
  Description of Artificial Sequence: Synthetic light chain variable domain
QIVLTQSPAILSLSPGERATMSCSASSSISYMHWFQQRPGQSPKRWIYDTSKLASGVPARFSGSGSGTSYTLTISSLEAEDFATYYCHQRTSYPLTFGQGTKLEIKR

SEQ ID NO: 3983 - protein, 107 aa, Artificial Sequence
  Description of Artificial Sequence: Synthetic light chain variable domain
QIVLTQSPATLSLSPGERATLSCSASSSISYMHWFQQRPGQSPRRWIYDTSKLASGVPARFSGSGSGTSYTLTISSLEAEDFATYYCHQRTSYPLTFGQGTKLEIKR

SEQ ID NO: 3984 - protein, 107 aa, Artificial Sequence
  Description of Artificial Sequence: Synthetic light chain variable domain
EIVLTQSPATLSLSPGERATLSCSASSSISYMHWFQQRPGQSPRRWIYDTSKLASGVPARFSGSGSGTDYTLTISSLEAEDFATYYCHQRTSYPLTFGQGTKLEIKR

SEQ ID NO: 3985 - protein, 107 aa, Artificial Sequence
  Description of Artificial Sequence: Synthetic light chain variable domain
EIVLTQSPATLSLSPGERATLSCSASSSISYMHWFQQRPGQSPRRWIYDTSKLASGVPARFSGSGSGTDYTLTISSLEPEDFATYYCHQRTSYPLTFGQGTKLEIKR

SEQ ID NO: 3986 - protein, 107 aa, Artificial Sequence
  Description of Artificial Sequence: Synthetic light chain variable domain
EIVLTQSPATLSLSPGERATMSCSASSSISYMHWFQQRPGQSPRRLIYDTSKLASGVPARFSGSGSGTDYTLTISSLEPEDFATYYCHQRTSYPLTFGQGTKLEIKR

SEQ ID NO: 3987 - protein, 106 aa, Artificial Sequence
  Description of Artificial Sequence: Synthetic light chain variable domain
QIVLTQSPAIMSASPGEKVTMTCSASSSISYMHWFQQKPGTSPKRWIYDTSKLASGVPARFSGSGSGTSYSLTINSMEAEDAATYYCHQRTSYPLTFGAGTKLELK

SEQ ID NO: 3988 - protein, 107 aa, Artificial Sequence
  Description of Artificial Sequence: Synthetic light chain variable domain
QAVVTQESAFTTSPGGTVILTCRSSTGAVTTNNYANWVQEKPDHLFTGLIGGTSNRAPGVPVRFSGSLIGDKAALTITGAQTEDDGMYFCALWYTTHFVFGGGTKVT

SEQ ID NO: 3989 - protein, 106 aa, Artificial Sequence
  Description of Artificial Sequence: Synthetic light chain variable domain
QIVLTQSPAIMSASPGEKVTMTCSASSSVTYMHWFQQKPGTSPKLWIYSTSILASGVPARFSGSGSGTSYSLTISRMEAEDAATYYCQQRTSYPLTFGTGTKLELK

SEQ ID NO: 3990 - protein, 108 aa, Artificial Sequence
  Description of Artificial Sequence: Synthetic light chain variable domain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 3991 - protein, 215 aa, Artificial Sequence
  Description of Artificial Sequence: Synthetic light chain variable domain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3992 - protein, 112 aa, Artificial Sequence
  Description of Artificial Sequence: Synthetic light chain variable domain
DIVMTQSPDSLAVSLGERATINCKSSQSLFNSRTRKNYLAWYQQKPGQPPKLLIYWASTRESGVPDRFSGSGSGTDFTLTISSLQAEDVAVYYCMQSFNLRTFGQGTKVEIK

SEQ ID NO: 3993 - protein, 112 aa, Artificial Sequence
  Description of Artificial Sequence: Synthetic light chain variable domain
DIVMTQSPDSLAVSLGERATINCKSSQSLFNSRTRKNYLAWYQQKPGQPPKLLIYWASARDSGVPDRFSGSGSGTDFTLTISSLQAEDVAVYYCMQSFNLRTFGQGTKVEIK

SEQ ID NO: 3994 - protein, 112 aa, Artificial Sequence
  Description of Artificial Sequence: Synthetic light chain variable domain
DIVMTQSPSSLAVSLGERATMSCKSSQSLFNSRTRKNYLAWYQQKPGQSPKLLIYWASARDSGVPARFTGSGSETYFTLTISRVQAEDLAVYYCMQSFNLRTFGQGTKVEIK

SEQ ID NO: 3995 - protein, 112 aa, Artificial Sequence
  Description of Artificial Sequence: Synthetic light chain variable domain
DIVMTQSPDSLAVSLGERATMSCKSSQSLFNSRTRKNYLAWYQQKPGQPPKLLIYWASARDSGVPDRFSGSGSETYFTLTISRVQAEDLAVYYCMQSFNLRTFGQGTKVEIK

SEQ ID NO: 3996 - protein, 112 aa, Artificial Sequence
  Description of Artificial Sequence: Synthetic light chain variable domain
DIVMTQSPDSLAVSLGERATMSCKSSQSLFNSRTRKNYLAWYQQKPGQPPKLLIYWASARDSGVPDRFTGSGSETYFTLTISRVQAEDVAVYYCMQSFNLRTFGQGTKVEIK

SEQ ID NO: 3997 - protein, 112 aa, Artificial Sequence
  Description of Artificial Sequence: Synthetic light chain variable domain
DIVMTQSPDSLAVSLGERATMSCKSSQSLFNSRTRKNYLAWYQQKPGQPPKLLIYWASARDSGVPDRFTGSGSETYFTLTISSLQAEDLAVYYCMQSFNLRTFGQGTKVEIK

SEQ ID NO: 3998 - protein, 112 aa, Artificial Sequence
  Description of Artificial Sequence: Synthetic light chain variable domain
DIVMTQSPDSLAVSLGERATINCKSSQSLFNSRTRKNYLAWYQQKPGQPPKLLIYWASARDSGVPDRFTGSGSETYFTLTISSLQAEDVAVYYCMQSFNLRTFGQGTKVEIK

SEQ ID NO: 3999 - protein, 219 aa, Artificial Sequence
  Description of Artificial Sequence: Synthetic light chain variable domain
DIVMTQSPDSLAVSLGERATINCKSSQSLFNSRTRKNYLAWYQQKPGQPPKLLIYWASTRESGVPDRFSGSGSGTDFTLTISSLQAEDVAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4000 - protein, 219 aa, Artificial Sequence
  Description of Artificial Sequence: Synthetic light chain variable domain
DIVMTQSPDSLAVSLGERATINCKSSQSLFNSRTRKNYLAWYQQKPGQPPKLLIYWASARDSGVPDRFSGSGSGTDFTLTISSLQAEDVAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4001 - protein, 219 aa, Artificial Sequence
  Description of Artificial Sequence: Synthetic light chain variable domain
DIVMTQSPDSLAVSLGERATMSCKSSQSLFNSRTRKNYLAWYQQKPGQPPKLLIYWASARDSGVPDRFSGSGSETYFTLTISRVQAEDLAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4002 - protein, 219 aa, Artificial Sequence
  Description of Artificial Sequence: Synthetic light chain variable domain
DIVMTQSPDSLAVSLGERATMSCKSSQSLFNSRTRKNYLAWYQQKPGQPPKLLIYWASARDSGVPDRFTGSGSETYFTLTISRVQAEDVAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4003 - protein, 219 aa, Artificial Sequence
  Description of Artificial Sequence: Synthetic light chain variable domain
DIVMTQSPDSLAVSLGERATMSCKSSQSLFNSRTRKNYLAWYQQKPGQPPKLLIYWASARDSGVPDRFTGSGSETYFTLTISSLQAEDLAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4004 - protein, 219 aa, Artificial Sequence
  Description of Artificial Sequence: Synthetic light chain variable domain
DIVMTQSPDSLAVSLGERATINCKSSQSLFNSRTRKNYLAWYQQKPGQPPKLLIYWASARDSGVPDRFTGSGSETYFTLTISSLQAEDVAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4005 - protein, 213 aa, Artificial Sequence
  Description of Artificial Sequence: Synthetic light chain variable domain
DIQMTQSPILLSASVGDRVTITCSASSSISYMHWYQQRTNGSPRLLIYTTSNLASGVPARFSGSGSGTEFTLTISSLQPDDIADYYCHQRSTYPLTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4006 - protein, 213 aa, Artificial Sequence
  Description of Artificial Sequence: Synthetic light chain variable domain
DIQMTQSPILLSASVGDRVTITCSASSSISYMHWYQQRTNGSPRLLIYTTSNLASGVPARFSGSGSGTEFTLTISSLQPDDEADYYCHQRSTYPLTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4007 - protein, 107 aa, Artificial Sequence
  Description of Artificial Sequence: Synthetic light chain variable domain
DIVMTQSHKFMSTSVGDRVSITCKASQDVNTAVAWYQQKPGQSPKLLIYWASTRHTGVPDRFTGSGSGTDYTLTIKSVQAEDLTLYYCQQHYITPWTFGGGTKLEIK

SEQ ID NO: 4008 - protein, 107 aa, Artificial Sequence
  Description of Artificial Sequence: Synthetic light chain variable domain
DIQMTQSPSFLSASVGDRVTITCKASQDVNTAVAWYQQKPGKAPKLLIYWASTRHTGVPSRFSGSGSGTDFTLTISSLQPEDVATYYCQQHYITPWTFGGGTKLEIK

SEQ ID NO: 4009 - protein, 107 aa, Artificial Sequence
  Description of Artificial Sequence: Synthetic light chain variable domain
DIQMTQSPSFLSASVGDRVTITCRASQDVNTAVAWYQQKPGKAPKLLIYWASTRHTGVPDRFSGSGSGTDFTLTISSLQPEDVATYYCQQHYITPWTFGGGTKLEIK

SEQ ID NO: 4010 - protein, 107 aa, Artificial Sequence
  Description of Artificial Sequence: Synthetic light chain variable domain
DIQMTQSPSFLSASVGDRVTITCRASQDVNTAVAWYQQKPGKAPKLLIYWASTRHTGVPSRFSGSGSGTDFTLTISSLQPEDIATYYCQQHYITPWTFGGGTKLEIK

SEQ ID NO: 4011 - protein, 111 aa, Artificial Sequence
  Description of Artificial Sequence: Synthetic light chain variable domain
DIVLTQSPASLAVSLGQRATISCRASKSVSSSGYSYMHWYQQKPGQPPKVLIFLSSNLDSGVPARFSGSGSGTDFTLNIHPVEDGDAATYYCQHSRDLPPTFGGGTKLEIK

SEQ ID NO: 4012 - protein, 109 aa, Artificial Sequence
  Description of Artificial Sequence: Synthetic light chain variable domain
DIAMTQSHKFMSTLVGDRVSITCKASQDVNTAIAWYQQKPGQSPKLLIYWASTRHTGVPDRFYGSGSGTDYTLTISSMEAEDAATYYCQQWSSNPLTFGAGTKLELKRA

SEQ ID NO: 4013 - protein, 104 aa, Artificial Sequence
  Description of Artificial Sequence: Synthetic light chain variable domain
DIVMTQSHKFMSTSVGDRVSITCKASQDVNTAIAWYQQKPGQSPKLLIYWASTRHTGVPDRFTGSGSGTDYTLTISSVQAEDLALYYCQQHYTTPFTFGSGTKL

SEQ ID NO: 4014 - protein, 108 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKR

SEQ ID NO: 4015 - protein, 107 aa, Artificial Sequence
  Description of Artificial Sequence: Synthetic light chain variable domain
DIQMTQSPSFLSASVGDRVTITCRASQDVNTAVAWYQQKPGKAPKLLIYWASTRHTGVPDRFSGSGSGTDFTLTISSLQPEDIATYYCQQHYITPWTFGGGTKLEIK

SEQ ID NO: 4016 - protein, 108 aa, Artificial Sequence
  Description of Artificial Sequence: Synthetic light chain variable domain
EIVLTQSPGTLSLSPGERATLSCRASQGISRSYLAWYQQKPGQAPSLLIYGASSRATGIPDRFSGSGSGTDFTLTISRLEPEDFAVYYCQQFGSSPWTFGQGTKVEIK

SEQ ID NO: 4017 - protein, 108 aa, Artificial Sequence
  Description of Artificial Sequence: Synthetic light chain variable domain
SELTQDPAVSVALGQTVRITCSGDSLRSYYASWYQQKPGQAPVLVIYGANNRPSGIPDRFSGSSSGNTASLTITGAQAEDEADYYCNSADSSGNHVVFGGGTKLTVLG

SEQ ID NO: 4018 - protein, 106 aa, Artificial Sequence [sequence omitted]

SEQ ID NO: 4019 - protein, 111 aa, Artificial Sequence
  Description of Artificial Sequence: Synthetic light chain variable domain
SYELTQPPSVSGTPGQRVAISCSGSSSNIGTRMVTWYQHVPGTAPKLLIFNNNQRPSGVPDRFSASKSGTSASLAIIGLQSDDEADYYCATWDENPKSYVFGTGTKVTVLG

SEQ ID NO: 4020 - protein, 111 aa, Artificial Sequence
  Description of Artificial Sequence: Synthetic light chain variable domain
SYELTQPPSVSGTPGQRVAISCSGSSSNIGTRMVTWYQHVPGTAPKLLIFNNNQRPSGVPDRFSASKSGTSASLAIIGLQSDDEADYYCATWEDNRKSYVFGTGTKVTVLG

SEQ ID NO: 4021 - protein, 111 aa, Artificial Sequence
  Description of Artificial Sequence: Synthetic light chain variable domain
SYELTQPPSVSGTPGQRVAISCSGSSSNIGTRVVTWYQHVPGTAPKLLIFNNNQRPSGVPDRFSASKSGTSASLAIIGLQSDDEADYYCAAWDDNLKSYVFGTGTKVTVLG

SEQ ID NO: 4022 - protein, 111 aa, Artificial Sequence
  Description of Artificial Sequence: Synthetic light chain variable domain
SYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLG

SEQ ID NO: 4023 - protein, 111 aa, Artificial Sequence
  Description of Artificial Sequence: Synthetic light chain variable domain
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNPKSYHFGTGTKVTVLG

SEQ ID NO: 4024 - protein, 111 aa, Artificial Sequence
  Description of Artificial Sequence: Synthetic light chain variable domain
SYELTQPPSVSGTPGQRVAISCSGSSSNIGTRMVTWYQHVPGTAPKLLIFNNNQRPSGVPDRFSASKSGTSASLTIIGLQSDDEADYYCAAWDDNLKSYVFGTGTKVTVLG

SEQ ID NO: 4025 - protein, 111 aa, Artificial Sequence
  Description of Artificial Sequence: Synthetic light chain variable domain
QAVLTQPPSASGTPGQRVTISCSGSSSNIGTNPVTWYQHLPGTAPKLLIYGNYQRPSGVPDRFSGSKSGTSASLAISGLQSEDEADYYCAAWDDSLTGYVFGTGTKVTVLG

SEQ ID NO: 4026 - protein, 111 aa, Artificial Sequence
  Description of Artificial Sequence: Synthetic light chain variable domain
QSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLG

SEQ ID NO: 4027 - protein, 111 aa, Artificial Sequence
  Description of Artificial Sequence: Synthetic light chain variable domain
QSVVTQPPSVSAAPGQKVTISCSGSSSNIGNNYVSWYQHFPGAAPKLLIYDNYKRPSGIPDRFSGSKSGTSATLGITGLQTGDEAEYYCGTWDSSLSAYVFGTGTKVTVLG

SEQ ID NO: 4028 - protein, 109 aa, Artificial Sequence
  Description of Artificial Sequence: Synthetic light chain variable domain
SYELTQPPSVSVAPGKTARITCGGNNIGSKSVHWYQQKPGQAPVLVIYYNSDRPSGIPERFSGSNSGNTATLTISRVEAGDEADYYCQVWDSSSDHWVFGGGTKLTVLG

SEQ ID NO: 4029 - protein, 111 aa, Artificial Sequence
  Description of Artificial Sequence: Synthetic light chain variable domain
QSVLTQPPSASGTPGQRVTISCSGHNSNIETNPVSWYQQVPGTTPKLLIYSYYYRPSGVPDRFSGSKSGTSASLAISGLQSEDEADYFCASWDDSVQGYVFGSGTKVTVLG

SEQ ID NO: 4030 - protein, 109 aa, Artificial Sequence
  Description of Artificial Sequence: Synthetic light chain variable domain
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHQVFGTGTKVTVLG

SEQ ID NO: 4031 - protein, 109 aa, Artificial Sequence
  Description of Artificial Sequence: Synthetic light chain variable domain
QSVLTQPPSVSVAPGKTARITCGGNNIGSKNVHWYQQKPGQAPVLVVYDDHDGPSGIPERFSGSNSGNTATLTISRVEAGDEADYYCQVWDSSSDHVVFGGGTKLTVLG

SEQ ID NO: 4032 - protein, 110 aa, Artificial Sequence
  Description of Artificial Sequence: Synthetic light chain variable domain
QAVLTQPPSASGTPGQRVTISCSGSSSNIGINTVNWYQQLPGTAPKLLIYGNSHRPSGVPDRFSGSKSGASASLAITGLQADDEGAYFCQSYDTSLTVIFGGGTKLTVLG

SEQ ID NO: 4033 - protein, 112 aa, Artificial Sequence
  Description of Artificial Sequence: Synthetic light chain variable domain
QTVVTQEPSLTVSPGGTVTLTCASSTGAVTSGYYPNWFQQKPGQAPRALIYSTNNKHSWTPARFSGSLLGGKAALTLSGVQPEDEAEYYCLLYYGGAQLWVFGGGTKLTVLG

SEQ ID NO: 4034 - protein, 108 aa, Artificial Sequence
  Description of Artificial Sequence: Synthetic light chain variable domain
DIQMTQSPSSLSASVGDRVTITCRASQSISSYLNWYQQKPGQAPNLLIYGASSFQSGVPSRFSGSGSGTDFTLTISSLQPEDFATYYCQQSYSAPLTFGGGTKVDIKR

SEQ ID NO: 4035 - protein, 111 aa, Artificial Sequence
  Description of Artificial Sequence: Synthetic light chain variable domain
QAVLTQPPSASGTPGQRVTISCSGSSSNIGSNSVNWYQQVPGTAPKLLIYSNNQRPSGVPDRFSGSKSGTSASLAITKLQSEDEADYYCAAWDDSLNGYVFGTGTKVTVLG

SEQ ID NO: 4036 - protein, 111 aa, Artificial Sequence
  Description of Artificial Sequence: Synthetic light chain variable domain
QSVLTQPPSVSGAPGQRVTISCTGSSSNIGAGYDVHWYQQLPGTAPKLLIYESNNRPSGVPDRFSGSKSGTSASLAITGLQAEDEADYYCQSYDTSLKGVFGPGTKVTVLG

SEQ ID NO: 4037 - protein, 109 aa, Artificial Sequence
  Description of Artificial Sequence: Synthetic light chain variable domain
SSELTQDPAVSVALGQTVTITCQGDILRNYYATWYQQKPGQAPSLVLYGQNNRPSGIPDRFSGSTSGNTASLTITGAQAEDEGDYYCDSRDSSGNHWVFGGGTKLTVLG

SEQ ID NO: 4038 - protein, 110 aa, Artificial Sequence
  Description of Artificial Sequence: Synthetic light chain variable domain
SSELTQDPALSVALGQTVTITCRGDNLRNSYASWYQQKPGQAPVVVLYGKNRRPSGIPDRFSGSSSGNTASLTITGAQADDEADYYCNSRDSSGFPPYVFGPGTKVTVLG

SEQ ID NO: 4039 - protein, 108 aa, Artificial Sequence
  Description of Artificial Sequence: Synthetic light chain variable domain
SYVLTQPPSVSVSPGQTASITCSGDKLGEKYVYWYQQRPGQSPVLVIFQNDKRPSGIPERLSGSRSGNTATLTISGTQAMDEADYYCQSWASSSVYVFGTGTKLTVLG

SEQ ID NO: 4040 - protein, 109 aa, Artificial Sequence
  Description of Artificial Sequence: Synthetic light chain variable domain
SSELTQDPAVSVALGQTVRITCQGDSLRNYYASWYQQKPGQAPVLVLYGKDNRPSGIPDRFSGSSSGNTASLTITGAQAEDEADYYCNSRDSSGNHRVFGGGTKLTVLG

SEQ ID NO: 4041 - protein, 111 aa, Artificial Sequence
  Description of Artificial Sequence: Synthetic light chain variable domain
QAVLTQPPSASGTPGQRVTISCSGSSSNIGSNHVNWYQQLPGTAPKLLISNNNQRPSGVPDRFSGSKSGTSASLAISGLQSEDEADYYCAAWDDSLNVPVFGGGTQLTVLS

SEQ ID NO: 4042 - protein, 109 aa, Artificial Sequence
  Description of Artificial Sequence: Synthetic light chain variable domain
SSELTQDPAVSVALGQTVRITCQGDTLRSFYASWYQQKPGQAPVLVFYGKNNRPSGIPERFSGSNSENTASLTIAGAQAEDEADYYCNSRDSGGDPVVFGGGTKLTVLG

SEQ ID NO: 4043 - protein, 110 aa, Artificial Sequence
  Description of Artificial Sequence: Synthetic light chain variable domain
QAVVTQEPSLTVSPGGTVTLTCASSTGAVTSSYYPNWFQQKPGQAPRALIYSTSNTHSWTPARFSGSLLGGKAALTVSGVQPEDEAEYYCLLYYGGARVFGGGTKLTVLG

SEQ ID NO: 4044 - protein, 111 aa, Artificial Sequence
  Description of Artificial Sequence: Synthetic light chain variable domain
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNLKSYVFGTGTKVTVLG

SEQ ID NO: 4045 - protein, 107 aa, Artificial Sequence
  Description of Artificial Sequence: Synthetic light chain variable domain
DIQMTQSPSSLSASVGDRVTITCRASQNVGTNVAWFQQKPGKAPKSLIHSASYRYSGVPSRFSGSGSGTDFTLTISSLQPEDFATYYCQQYKRYPYTFGGGTKLEIK

SEQ ID NO: 4046 - protein, 107 aa, Artificial Sequence
  Description of Artificial Sequence: Synthetic light chain variable domain
EIVLTQSPGTLSLSPGERATLSCKASQSVGNNVAWYQQKPGQAPRLLIYYASNRYTGIPDRFSGSGSGTDFTLTISRLEPEDFAVYYCQQHYSSPLTFGAGTKLEIK

SEQ ID NO: 4047 - protein, 112 aa, Artificial Sequence
  Description of Artificial Sequence: Synthetic light chain variable domain
DIVMTQTPLSLSVTPGQPASISCRSSQSLVHSNGNTFLYWYLQKPGQSPQLLIYRVSNRFSGVPDRFSGSGSGTDFTLKISRVEAEDVGVYYCFQATHVPWTFGGGTKVEIK

SEQ ID NO: 4048 - protein, 111 aa, Artificial Sequence
  Description of Artificial Sequence: Synthetic light chain variable domain
EIVLTQSPATLSLSPGERATLSCRASQSVSSSSYTYIHWYQQKPGQAPRLLINFASNLESGIPARFSGSGSGTDFTLTISSLEPEDFAVYYCQHSWEIPPTFGGGTKLEIK

SEQ ID NO: 4049 - protein, 112 aa, Artificial Sequence; identical to SEQ ID NO: 4047
  Description of Artificial Sequence: Synthetic light chain variable domain

SEQ ID NO: 4050 - protein, 111 aa, Artificial Sequence; identical to SEQ ID NO: 4048
  Description of Artificial Sequence: Synthetic light chain variable domain

SEQ ID NO: 4051 - protein, 445 aa, Artificial Sequence
  Description of Artificial Sequence: Synthetic light chain variable domain
EVQLQESGPGLVKPSQTLSLTCTVSGYSISRDFAWNWIRQPPGKGLEWMGYISYNGNTRYQPSLKSRITISRDTSKNQFFLKLNSVTAADTATYYCVTASRGFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4052 - protein, 330 aa, Artificial Sequence [sequence omitted]

SEQ ID NO: 4053 - protein, 108 aa, Artificial Sequence
  Description of Artificial Sequence: Synthetic light chain variable domain
DIQMTQSPSSLSASLGGKVTITCKASQDINNYIAWYQHKPGKGPRLLIHYTSTLHPGIPSRFSGSGSGRDYSFSISNLEPEDIATYYCLQYDNLLYTFGGGTKLEIKR

SEQ ID NO: 4054 - protein, 108 aa, Artificial Sequence
  Description of Artificial Sequence: Synthetic light chain variable domain
DIQMTQSPSSLSASLGGKVTITCKASQDINNYLAWYQHKPGKGPRLLIHYTSTLHPGIPSRFSGSGSGRDYSFSISNLEPEDIATYYCLQYDNLLYTFGGGTKLEIKR

SEQ ID NO: 4055 - protein, 108 aa, Artificial Sequence
  Description of Artificial Sequence: Synthetic light chain variable domain
DIQMTQSPSSLSASVGDRVTITCKASQDINNYLAWYQHKPGKGPKLLIHYTSTLHPGIPSRFSGSGSGRDYSFSISSLEPEDIATYYCLQYDNLLYTFGQGTKLEIKR

SEQ ID NO: 4056 - protein, 108 aa, Artificial Sequence
  Description of Artificial Sequence: Synthetic light chain variable domain
DIQMTQSPSSLSASVGDRVTITCRASQDINNYLAWYQHKPGKGPKLLIHYTSTLHPGIPSRFSGSGSGRDYSFSISSLEPEDIATYYCLQYDNLLYTFGQGTKLEIKR

SEQ ID NO: 4057 - protein, 108 aa, Artificial Sequence
  Description of Artificial Sequence: Synthetic light chain variable domain
DVQITQSPSSLAASVGERITINCRASKSISKYLAWYQEKPGKTNKLLIYSGSTLQSGIPSRFSGSGSGTDFTLTISSLEPEDFAMYYCQQHNEYPWTFGQGTKLEIKR

SEQ ID NO: 4058 - protein, 108 aa, Artificial Sequence
  Description of Artificial Sequence: Synthetic light chain variable domain
DVQITQSPSSLAASVGERITINCRASQSISRYLAWYQEKPGKTNKLLIYSGSTLQSGIPSRFSGSGSGTDFTLTISSLEPEDFAMYYCQQHNEYPWTFGQGTKLEIKR

SEQ ID NO: 4059 - protein, 108 aa, Artificial Sequence
  Description of Artificial Sequence: Synthetic light chain variable domain
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKR

SEQ ID NO: 4060 - protein, 108 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 4061 - protein, 107 aa, Artificial Sequence
  Description of Artificial Sequence: Synthetic light chain variable domain
EIVLTQSPDFQSVTPKEKVTITCRASQSIGTNIHWYQQKPDQSPKLLIKYASESISGVPSRFSGSGSGTDFTLTINSLEAEDAADYYCQQNNNWPTTFGAGTKLEIK

SEQ ID NO: 4062 - protein, 108 aa, Artificial Sequence
  Description of Artificial Sequence: Synthetic light chain variable domain
EIVLTQSPDFQSVTPKEKVTITCRASQSIGTNIHWYQQKPDQSPKLLIKYASESISGVPSRFSGSGSGTDFTLTINSLEAEDAADYYCQQNNNWPTTFGQGTKLEIKR

SEQ ID NO: 4063 - protein, 108 aa, Artificial Sequence
  Description of Artificial Sequence: Synthetic light chain variable domain
EIVLTQSPDFQSVTPKEKVTITCRASQSIGTNIHWYQQKPDQSPKLLIKYASESISGVPSRFSGSGSGTDFTLTINSLEAEDAATYYCQQNNNWPTTFGQGTKLEIKR

SEQ ID NO: 4064 - protein, 108 aa, Artificial Sequence
  Description of Artificial Sequence: Synthetic light chain variable domain
  MOD_RES (11)..(11): Any amino acid
  MOD_RES (21)..(21): Any amino acid
  MOD_RES (45)..(45): Any amino acid
  MOD_RES (83)..(83): Any amino acid
  MOD_RES (85)..(85): Any amino acid
  MOD_RES (100)..(100): Any amino acid
EIVLTQSPDFXSVTPKEKVTXTCRASQSIGTNIHWYQQKPDQSPXLLIKYASESISGVPSRFSGSGSGTDFTLTINSLEAEDXAXYYCQQNNNWPTTFGXGTKLEIKR

SEQ ID NO: 4065 - protein, 113 aa, Artificial Sequence
  Description of Artificial Sequence: Synthetic light chain variable domain
DIVMTQTPLSLPVTPGEPASISCRSNQDLTHSNGNTYLEWYLQKPGQSPRLLIYKVSNRFSGVPDRFSGSGAGTDFTLRISRVEAEDVGVYYCMQGTHWPWTFGQGTKVDIKR

SEQ ID NO: 4066 - protein, 113 aa, Artificial Sequence
  Description of Artificial Sequence: Synthetic light chain variable domain
DIVMTQTPLSLPVTPGEPASISCRSSQSVDMGIGNNYLEWYLQKPGQSPRLLIYKVSNRFSGVPDRFSGSGAGTDFTLRISRVEAEDVGVYYCMQGTHWPWTFGQGTKVDIKR

SEQ ID NO: 4067 - protein, 107 aa, Artificial Sequence
  Description of Artificial Sequence: Synthetic light chain variable domain
DIQMTQSPSSLSASVGDRVTITCRASQDIGNYLAWYQQKPGKVPKLLIYYTSTLQSGVPSRFSGSGSGTDFTLTISSLQPEDVATYYCQHYNTVPPTFGGGTKVEIK

SEQ ID NO: 4068 - protein, 219 aa, Artificial Sequence
  Description of Artificial Sequence: Synthetic light chain variable domain
DIVMTQAAFSNPVTLGTSASISCRSSKSLLHSNGITYLYWYLQKPGQSPQLLIYQMSNLASGVPDRFSSSGSRTDFTLRISRVEAEDVGVYYCAQNLELPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4069 - protein, 112 aa, Artificial Sequence
  Description of Artificial Sequence: Synthetic light chain variable domain
DIVMTQSPLSLPVTPGEPASISCRSSKSLLHSNGITYLDWYLQKPGQSPQLLIYQMSNLASGVPDRFSSSGSGTDFTLRISRVEAEDVGVYYCAQNLELPYTFGGGTKLEIK

SEQ ID NO: 4070 - protein, 216 aa, Artificial Sequence
  Description of Artificial Sequence: Synthetic light chain variable domain
LADIQMTQTTSSLSASLGDRVTISCRASQDISNYLNWYQQKPDGTVKVLIYYTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4071 - protein, 216 aa, Artificial Sequence
  Description of Artificial Sequence: Synthetic light chain variable domain
LADIQMTQTTSSLSASLGDRVTISCRTSQDIGNYLNWYQQKPDGTVKLLIYYTSRLHSGVPSRFSGSGSGTDFSLTINNVEQEDVATYFCQHYNTVPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4072 - protein, 216 aa, Artificial Sequence
  Description of Artificial Sequence: Synthetic light chain variable domain
LADIQMTQTTSSLSASLGDRVTISCSASQDISNYLNWYQQKPDGTVKLLIYHTSTLHSGVPSRFSGSGSGTDYSLTISNLEPEDIATYYCQQYSKLPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4073 - protein, 216 aa, Artificial Sequence
  Description of Artificial Sequence: Synthetic light chain variable domain
LADIQMTQTTSSLSASLGDRVTISCSASQGISNYLNWYQQKPDGTVKLLIYYTSSLHSGVPSRFSGSGSGTDYSLTISNLEPEDIATYYCQQYSKLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4074 - protein, 216 aa, Artificial Sequence
  Description of Artificial Sequence: Synthetic light chain variable domain
LADIQMTQTTSSLSASLGDRVTISCSASQGITNYLNWYQQKPDGTVKLLIYYSSSLHSGVPSRFSGSGSGTDYSLTISNLEPEDIATYYCQQYSEIPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4075 - protein, 220 aa, Artificial Sequence
  Description of Artificial Sequence: Synthetic light chain variable domain
LADIVLTQSPASLAVSLGQRATISCRASKSVSTSGYSFMHWYQLKPGQPPKLLIYLASNLESGVPARFSGSGSGTDFTLNIHPVEEEDAATYYCQHSREFPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4076 - protein, 220 aa, Artificial Sequence
  Description of Artificial Sequence: Synthetic light chain variable domain
LADIVLTQSPASLAVSLGQRATISCRASQSVSTSTYSYMHWYQQKSGQPPKLLIKYASNLESGVPARFSGSGSGTDFTLNIHPVEEEDTATYYCQHSWEIPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4077 - protein, 221 aa, Artificial Sequence
  Description of Artificial Sequence: Synthetic light chain variable domain
LADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4078 - protein, 216 aa, Artificial Sequence
  Description of Artificial Sequence: Synthetic light chain variable domain
LADIVMTQSHKFMSTSVGDRVSITCKASQDVTNAVAWYQQKPGQSPKLLIYWASIRHTGVPDRFTGSRSGTDYTLTINSVQAEDLALYYCQQHYNTPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4079 - protein, 220 aa, Artificial Sequence
  Description of Artificial Sequence: Synthetic light chain variable domain
LADVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4080 - protein, 220 aa, Artificial Sequence
  Description of Artificial Sequence: Synthetic light chain variable domain
LADVVMTQTPLSLPVSLGDQASISCRSSQSLVHSNGNTYLHWYLQKPGQSPKLLLYKVSNRFSGVPDRFSGSGSGTDFTLKISRVESEDLGVYFCSQNTHVYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4081 - protein, 217 aa, Artificial Sequence
  Description of Artificial Sequence: Synthetic light chain variable domain
LAENVLTQSPAIMSASPGEKVTMTCRASSSVSSSYLHWYQQKSGASPKLWIYSTSNLASGVPARFSGSGSGTSYSLTVNSVETEDAATYYCHQYSGFPFTFGSGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4082 - protein, 215 aa, Artificial Sequence
  Description of Artificial Sequence: Synthetic light chain variable domain
LAQIVLTQSPAIMSASPGEKVTITCSASSSVSYMHWFQQKPGTSPKLWIYSTSNLASGVPARFSGSGSGTSYSLTISRMEAEDAATYYCQQRSSYPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4083 - protein, 215 aa, Artificial Sequence
  Description of Artificial Sequence: Synthetic light chain variable domain
LAQIVLTQSPAIMSASPGEKVTMTCSASSSVSYIYWYQQKPGSSPRLLIYDASNLASGVPVRFSGSGSGTSYSLTISRMEAEDAATYYCQQWSSYPITFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4084 - protein, 616 aa, Artificial Sequence
  Description of Artificial Sequence: Synthetic light chain variable domain
LEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSQKTKIISNRGENSCKATGQVCHALCSPEGCWGPEPKDCVSCNVSRGRECVDKCNILEGEPREFVENSECIQCHPECLPQMNITCTGRGPDNCIQCAHYIDGPHCVKTCPAGVMGENNTLVWKYADAGHVCHLCHPNCTYGCTGPGLEGCNGPKIPS

SEQ ID NO: 4085 - protein, 107 aa, Artificial Sequence
  Description of Artificial Sequence: Synthetic light chain variable domain
DIQMTQTTSSLSASLGDRVTISCRSSQDIRNYLNWYQQKPDGTVKLLIYYTSRSHSGVPSRFSGSGSGTDYSLTISNLEQEDIATYFCQQGNMFPFTFGGGTKLEIK

SEQ ID NO: 4086 - protein, 107 aa, Artificial Sequence
  Description of Artificial Sequence: Synthetic light chain variable domain
AIQLTQSPSSLSASVGDRVTITCRASQSIGTNIHWYLQKPGQSPQLLIYYASESISGIPDRFSGSGSGTDFTLTISRLEPEDFAVYYCQQNNNWPTTFGAGTKLELK

SEQ ID NO: 4087 - protein, 107 aa, Artificial Sequence
  Description of Artificial Sequence: Synthetic light chain variable domain
AIQLTQSPSSLSASVGDRVTITCRASQSIGTNIHWYLQKPGQSPQLLIYYASESISGIPDRFSGSGSGTDFTLTISRLEPEDFAVYYCQQNNNWPTTFGQGTKLELK

SEQ ID NO: 4088 - protein, 107 aa, Artificial Sequence
  Description of Artificial Sequence: Synthetic light chain variable domain
AIQLTQSPSSLSASVGDRVTITCRASQSIGTNIHWYLQKPGQSPQLLIYYASESISGIPDRFSGSGSGTDFTLTISRLEPEDFAVYYCQQNNNWPTTFGQGTKVEIK

SEQ ID NO: 4089 - protein, 214 aa, Artificial Sequence
  Description of Artificial Sequence: Synthetic light chain variable domain
AIQLTQSPSSLSASVGDRVTITCRASQSIGTNIHWYLQKPGQSPQLLIYYASESISGIPDRFSGSGSGTDFTLTISRLEPEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4090 - protein, 107 aa, Artificial Sequence
  Description of Artificial Sequence: Synthetic light chain variable domain
AIQLTQSPSSLSASVGDRVTITCRASQSIGTNIHWYLQKPGQSPQLLIYYASESISGVPSRFSGSGSGTDFTLTISSLQPEDFATYYCQQNNNWPTTFGAGTKLELK

SEQ ID NO: 4091 - protein, 107 aa, Artificial Sequence
  Description of Artificial Sequence: Synthetic light chain variable domain
AIQLTQSPSSLSASVGDRVTITCRASQSIGTNIHWYLQKPGQSPQLLIYYASESISGVPSRFSGSGSGTDFTLTISSLQPEDFATYYCQQNNNWPTTFGQGTKLELK

SEQ ID NO: 4092 - protein, 107 aa, Artificial Sequence
  Description of Artificial Sequence: Synthetic light chain variable domain
AIQLTQSPSSLSASVGDRVTITCRASQSIGTNIHWYLQKPGQSPQLLIYYASESISGVPSRFSGSGSGTDFTLTISSLQPEDFATYYCQQNNNWPTTFGQGTKVEIK

SEQ ID NO: 4093 - protein, 107 aa, Artificial Sequence
  Description of Artificial Sequence: Synthetic light chain variable domain
AIQLTQSPSSLSASVGDRVTITCRASQSIGTNIHWYQQKPGKAPKLLIYYASESISGVPSRFSGSGSGTDFTLTISSLQPEDFATYYCQQNNNWPTTFGAGTKLELK

SEQ ID NO: 4094 - protein, 107 aa, Artificial Sequence
  Description of Artificial Sequence: Synthetic light chain variable domain
AIQLTQSPSSLSASVGDRVTITCRASQSIGTNIHWYQQKPGKAPKLLIYYASESISGVPSRFSGSGSGTDFTLTISSLQPEDFATYYCQQNNNWPTTFGQGTKLELK

SEQ ID NO: 4095 - protein, 107 aa, Artificial Sequence
  Description of Artificial Sequence: Synthetic light chain variable domain
AIQLTQSPSSLSASVGDRVTITCRASQSIGTNIHWYQQKPGKAPKLLIYYASESISGVPSRFSGSGSGTDFTLTISSLQPEDFATYYCQQNNNWPTTFGQGTKVEIK

SEQ ID NO: 4096 - protein, 107 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGIPARFSGSGSGTEFTLTISSLQSEDFAVYYCQQNNNWPTTFGAGTKLELK

SEQ ID NO: 4097 - protein, 107 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGIPARFSGSGSGTEFTLTISSLQSEDFAVYYCQQNNNWPTTFGQGTKLELK

SEQ ID NO: 4098 - protein, 107 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGIPARFSGSGSGTEFTLTISSLQSEDFAVYYCQQNNNWPTTFGQGTKVEIK

SEQ ID NO: 4099 - protein, 107 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGIPDRFSGSGSGTDFTLTISRLEPEDFAVYYCQQNNNWPTTFGQGTKLELK

SEQ ID NO: 4100 - protein, 107 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGIPDRFSGSGSGTDFTLTISRLEPEDFAVYYCQQNNNWPTTFGQGTKVEIK

SEQ ID NO: 4101 - protein, 214 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGIPDRFSGSGSGTDFTLTISRLEPEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4102 - protein, 107 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGIPPRFSGSGSGTDFTLTISRLEPEDFAVYYCQQNNNWPTTFGQGTKLELK

SEQ ID NO: 4103 - protein, 107 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGIPPRFSGSGSGTDFTLTISRLEPEDFAVYYCQQNNNWPTTFGQGTKVEIK

SEQ ID NO: 4104 - protein, 214 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGIPPRFSGSGSGTDFTLTISRLEPEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4105 - protein, 107 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGVPSRFSGSGSGTDFTLTISSLQPEDFATYYCQQNNNWPTTFGAGTKLELK

SEQ ID NO: 4106 - protein, 107 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGVPSRFSGSGSGTDFTLTISSLQPEDFATYYCQQNNNWPTTFGQGTKLELK

SEQ ID NO: 4107 - protein, 107 aa, Artificial Sequence
  Description of Artificial Sequence: Synthetic light chain variable domain
AIQLTQSPSSLSASVGDRVTITCRASQSIGTNIHWYQQKPGQAPRLLIYYASESISGVPSRFSGSGSGTDFTLTISSLQPEDFATYYCQQNNNWPTTFGQGTKVEIK

SEQ ID NO: 4108 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4109 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4110 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKVEIK

SEQ ID NO: 4111 - protein, 107 aa, Artificial Sequence
  Description of Artificial Sequence: Synthetic light chain variable domain
DILLTQSPVILSVSPGERVSFSCRASQSSGTNIHWYQQRTNGSPRLLIKYASESISGIPSRFSGSGSGTDFTLSINSVESEDIADYYCQQNNNWPTTFGEGTKLELK

SEQ ID NO: 4112 - protein, 107 aa, Artificial Sequence
  Description of Artificial Sequence: Synthetic light chain variable domain
DILLTQSPVILSVSPGERVSFSCRASQSSGTNIHWYQQRTNGSPRLLIKYASESISGIPSRFSGSGSGTDFTLSINSVESEDIADYYCQQNNNWPTTFGQGTKVEIK

SEQ ID NO: 4113 - protein, 107 aa, Artificial Sequence
  Description of Artificial Sequence: Synthetic light chain variable domain
DIQMTQSPSSLSASVGDRVTITCRASQSIGTNIHWYQQKPGQAPRLLIYYASESISGIPDRFSGSGSGTDFTLTISRLEPEDFAVYYCQQNNNWPTTFGAGTKLELK

SEQ ID NO: 4114 - protein, 107 aa, Artificial Sequence
  Description of Artificial Sequence: Synthetic light chain variable domain
DIQMTQSPSSLSASVGDRVTITCRASQSIGTNIHWYQQKPGQAPRLLIYYASESISGIPDRFSGSGSGTDFTLTISRLEPEDFAVYYCQQNNNWPTTFGQGTKLELK

SEQ ID NO: 4115 - protein, 107 aa, Artificial Sequence
  Description of Artificial Sequence: Synthetic light chain variable domain
DIQMTQSPSSLSASVGDRVTITCRASQSIGTNIHWYQQKPGQAPRLLIYYASESISGIPDRFSGSGSGTDFTLTISRLEPEDFAVYYCQQNNNWPTTFGQGTKVEIK

SEQ ID NO: 4116 - protein, 107 aa, Artificial Sequence
  Description of Artificial Sequence: Synthetic light chain variable domain
EIVLTQSPATLSLSPGERATLSCRASQSIGTNIHWYQQKPGKAPKLLIYYASESISGIPDRFSGSGSGTDFTLTISRLEPEDFAVYYCQQNNNWPTTFGQGTKLELK

SEQ ID NO: 4117 - protein, 107 aa, Artificial Sequence
  Description of Artificial Sequence: Synthetic light chain variable domain
EIVLTQSPATLSLSPGERATLSCRASQSIGTNIHWYQQKPGKAPKLLIYYASESISGIPDRFSGSGSGTDFTLTISRLEPEDFAVYYCQQNNNWPTTFGQGTKVEIK

SEQ ID NO: 4118 - protein, 214 aa, Artificial Sequence
  Description of Artificial Sequence: Synthetic light chain variable domain
EIVLTQSPATLSLSPGERATLSCRASQSIGTNIHWYQQKPGKAPKLLIYYASESISGIPDRFSGSGSGTDFTLTISRLEPEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4119 - protein, 107 aa, Artificial Sequence
  Description of Artificial Sequence: Synthetic light chain variable domain
EIVLTQSPATLSLSPGERATLSCRASQSIGTNIHWYQQKPGQAPRLLIYYASESISGIPARFSGSGSGTEFTLTISSLQSEDFAVYYCQQNNNWPTTFGQGTKLELK

SEQ ID NO: 4120 - protein, 107 aa, Artificial Sequence
  Description of Artificial Sequence: Synthetic light chain variable domain
EIVLTQSPATLSLSPGERATLSCRASQSIGTNIHWYQQKPGQAPRLLIYYASESISGIPARFSGSGSGTEFTLTISSLQSEDFAVYYCQQNNNWPTTFGQGTKVEIK

SEQ ID NO: 4121 - protein, 214 aa, Artificial Sequence
  Description of Artificial Sequence: Synthetic light chain variable domain
EIVLTQSPATLSLSPGERATLSCRASQSIGTNIHWYQQKPGQAPRLLIYYASESISGIPARFSGSGSGTEFTLTISSLQSEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4122 - protein, 107 aa, Artificial Sequence
  Description of Artificial Sequence: Synthetic light chain variable domain
EIVLTQSPATLSLSPGERATLSCRASQSIGTNIHWYQQKPGQAPRLLIYYASESISGVPSRFSGSGSGTDFTLTISSLQPEDFATYYCQQNNNWPTTFGQGTKLELK

SEQ ID NO: 4123 - protein, 107 aa, Artificial Sequence
  Description of Artificial Sequence: Synthetic light chain variable domain
EIVLTQSPATLSLSPGERATLSCRASQSIGTNIHWYQQKPGQAPRLLIYYASESISGVPSRFSGSGSGTDFTLTISSLQPEDFATYYCQQNNNWPTTFGQGTKVEIK

SEQ ID NO: 4124 - protein, 214 aa, Artificial Sequence
  Description of Artificial Sequence: Synthetic light chain variable domain
EIVLTQSPATLSLSPGERATLSCRASQSIGTNIHWYQQKPGQAPRLLIYYASESISGVPSRFSGSGSGTDFTLTISSLQPEDFATYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4125 - protein, 107 aa, Artificial Sequence
  Description of Artificial Sequence: Synthetic light chain variable domain
EIVLTQSPATLSLSPGERATLSCRASQSIGTNIHWYQQKPGQAPRLLIYYASESISGVPSRFSGSGSGTEFTLTISSLQPDDFATYYCQQNNNWPTTFGAGTKLELK

SEQ ID NO: 4126 - protein, 107 aa, Artificial Sequence
  Description of Artificial Sequence: Synthetic light chain variable domain
EIVLTQSPATLSLSPGERATLSCRASQSIGTNIHWYQQKPGQAPRLLIYYASESISGVPSRFSGSGSGTEFTLTISSLQPDDFATYYCQQNNNWPTTFGQGTKLELK

SEQ ID NO: 4127 - protein, 107 aa, Artificial Sequence
  Description of Artificial Sequence: Synthetic light chain variable domain
EIVLTQSPATLSLSPGERATLSCRASQSIGTNIHWYQQKPGQAPRLLIYYASESISGVPSRFSGSGSGTEFTLTISSLQPDDFATYYCQQNNNWPTTFGQGTKVEIK

SEQ ID NO: 4128 - protein, 107 aa, Artificial Sequence
  Description of Artificial Sequence: Synthetic light chain variable domain
EIVLTQSPATLSLSPGERATLSCRASQSIGTNIHWYQQRPGQAPRLLIKYASESISGIPARFSGSGSGTDFTLTISSLEPEDFAVYYCQQNNNWPTTFGGGTKVEIK

SEQ ID NO: 4129 - protein, 107 aa, Artificial Sequence
  Description of Artificial Sequence: Synthetic light chain variable domain
DIQMTQSPSSMSVSVGDRVTITCHSSQDINMNVGWLQQKPGKSFKGLIYHGAILDDGVPSRFSGSGSGTDYTLTISSLQPEDFATYYCVQYAEFPWTFGGGTKLEIK

SEQ ID NO: 4130 - protein, 107 aa, Artificial Sequence
  Description of Artificial Sequence: Synthetic light chain variable domain
DIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIK

SEQ ID NO: 4131 - protein, 107 aa, Artificial Sequence
  Description of Artificial Sequence: Synthetic light chain variable domain
DIQMTQSPSSMSVSVGDRVTITCHSSQDINSNIGWLQQKPGKSFKGLIYHGTNLDDGVPSRFSGSGSGTDYTLTISSLQPEDFATYYCVQYEQFPWTFGGGTKLEIK

SEQ ID NO: 4132 - protein, 107 aa, Artificial Sequence
  Description of Artificial Sequence: Synthetic light chain variable domain
DIQMTQSPSSMSVSVGDRVTITCHSSQDINSNLGWLQQKPGKSFKGLIYHGANLHDGVPSRFSGSGSGTDYTLTISSLQPEDFATYYCVQYAEFPWTFGGGTKLEIK

SEQ ID NO: 4133 - protein, 107 aa, Artificial Sequence
  Description of Artificial Sequence: Synthetic light chain variable domain
DIQMTQSPSSMSVSVGDRVTITCHSSQDINSNLGWLQQKPGKSFKGLIYHGSNLDHGVPSRFSGSGSGTDYTLTISSLQPEDFATYYCVQYDQFPWTFGGGTKLEIK

SEQ ID NO: 4134 - protein, 107 aa, Artificial Sequence
  Description of Artificial Sequence: Synthetic light chain variable domain
DIQMTQSPSSMSVSVGDRVTITCHSSQDITYNIGWLQQKPGKSFKGLIYHGANLDDGVPSRFSGSGSGTDYTLTISSLQPEDFATYYCVQYDEFPWTFGGGTKLEIK

SEQ ID NO: 4135 - protein, 107 aa, Artificial Sequence
  Description of Artificial Sequence: Synthetic light chain variable domain
DIQMTQSPSSMSVSVGDRVTITCHSSQDITYNVGWLQQKPGKSFKGLIYHGSNLDHGVPSRFSGSGSGTDYTLTISSLQPEDFATYYCVQYDDFPWTFGGGTKLEIK

SEQ ID NO: 4136 - protein, 108 aa, Artificial Sequence
  Description of Artificial Sequence: Synthetic light chain variable domain
EIVLTQSPATLSLSPGERATLSCRASQSVSSYLAWYQQKPGQAPRLLIFDASNRATGIPARFSGSGSGTDFTLTISSLEPEDFAVYYCQQRSNWPPWTFGQGTKVEIK

SEQ ID NO: 4137 - protein, 107 aa, Artificial Sequence [sequence omitted]

SEQ ID NO: 4138 - protein, 107 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIK

SEQ ID NO: 4139 - protein, 106 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWWTFGQGTKVEIK

SEQ ID NO: 4140 - protein, 113 aa, Artificial Sequence
  Description of Artificial Sequence: Synthetic light chain variable domain
DIQMTQSPSSLSASVGDRVTITCKSSQSLLASGNQNNYLAWHQQKPGKAPKMLIIWASTRVSGVPDRFIGSGSGTDFTLTISSLQAEDVAVYYCQQSYSAPLTFGQGTKLEIK

SEQ ID NO: 4141 - protein, 113 aa, Artificial Sequence
  Description of Artificial Sequence: Synthetic light chain variable domain
DIQMTQSPSSLSASVGDRVTITCKSSQSLLASGNQNNYLAWHQQKPGKAPKMLIIWASTRVSGVPDRFSGSGSGTDFTLTISSLQAEDVAVYYCQQSYSAPLTFGQGTKLEIK

SEQ ID NO: 4142 - protein, 114 aa, Artificial Sequence
  Description of Artificial Sequence: Synthetic light chain variable domain
DIQMTQSPSSLSASVGDRVTITCKSSQSLLASGNQNNYLAWHQQKPGKAPKMLIIWASTRVSGVPSRFSGSGSGTDFTLTISSLQPEDFATYYCQQSYSAPLTFGQGTKVEIKR

SEQ ID NO: 4143 - protein, 106 aa, Artificial Sequence
  Description of Artificial Sequence: Synthetic light chain variable domain
MTQSPSSLSASLGERVSLTCQASQGISNNLNWYQQTPGKAPRLLIYDASKLEDGVPSRFSGTGYRTDFNFTISSLEEEDVATYFCLQHRYLPVHVRRGDQVGNKTG

SEQ ID NO: 4144 - protein, 107 aa, Artificial Sequence
  Description of Artificial Sequence: Synthetic light chain variable domain
DCLLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4145 - protein, 107 aa, Artificial Sequence
  Description of Artificial Sequence: Synthetic light chain variable domain
DCLLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4146 - protein, 107 aa, Artificial Sequence
  Description of Artificial Sequence: Synthetic light chain variable domain
DIDLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4147 - protein, 107 aa, Artificial Sequence
  Description of Artificial Sequence: Synthetic light chain variable domain
DIDLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4148 - protein, 107 aa, Artificial Sequence
  Description of Artificial Sequence: Synthetic light chain variable domain
DIFLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4149 - protein, 107 aa, Artificial Sequence
  Description of Artificial Sequence: Synthetic light chain variable domain
DIFLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4150 - protein, 107 aa, Artificial Sequence
  Description of Artificial Sequence: Synthetic light chain variable domain
DIGLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4151 - protein, 107 aa, Artificial Sequence
  Description of Artificial Sequence: Synthetic light chain variable domain
DIGLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4152 - protein, 107 aa, Artificial Sequence
  Description of Artificial Sequence: Synthetic light chain variable domain
DILCTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4153 - protein, 107 aa, Artificial Sequence
  Description of Artificial Sequence: Synthetic light chain variable domain
DILCTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4154 - protein, 107 aa, Artificial Sequence
  Description of Artificial Sequence: Synthetic light chain variable domain
DILETQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4155 - protein, 107 aa, Artificial Sequence
  Description of Artificial Sequence: Synthetic light chain variable domain
DILETQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4156 - protein, 107 aa, Artificial Sequence
  Description of Artificial Sequence: Synthetic light chain variable domain
DILFTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4157 - protein, 107 aa, Artificial Sequence
  Description of Artificial Sequence: Synthetic light chain variable domain
DILFTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4158 - protein, 107 aa, Artificial Sequence
  Description of Artificial Sequence: Synthetic light chain variable domain
DILHTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4159 - protein, 107 aa, Artificial Sequence
  Description of Artificial Sequence: Synthetic light chain variable domain
DILHTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4160 - protein, 107 aa, Artificial Sequence
  Description of Artificial Sequence: Synthetic light chain variable domain
DILITQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4161 - protein, 107 aa, Artificial Sequence
  Description of Artificial Sequence: Synthetic light chain variable domain
DILITQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4162 - protein, 107 aa, Artificial Sequence
  Description of Artificial Sequence: Synthetic light chain variable domain
DILKTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4163 - protein, 107 aa, Artificial Sequence
  Description of Artificial Sequence: Synthetic light chain variable domain
DILKTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4164 - protein, 107 aa, Artificial Sequence
  Description of Artificial Sequence: Synthetic light chain variable domain
DILLAQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4165 - protein, 107 aa, Artificial Sequence
  Description of Artificial Sequence: Synthetic light chain variable domain
DILLAQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4166 - protein, 107 aa, Artificial Sequence
  Description of Artificial Sequence: Synthetic light chain variable domain
DILLCQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4167 - protein, 107 aa, Artificial Sequence
  Description of Artificial Sequence: Synthetic light chain variable domain
DILLCQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4168 - protein, 107 aa, Artificial Sequence
  Description of Artificial Sequence: Synthetic light chain variable domain
DILLDQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4169 - protein, 107 aa, Artificial Sequence
  Description of Artificial Sequence: Synthetic light chain variable domain
DILLDQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4170 - protein, 107 aa, Artificial Sequence
  Description of Artificial Sequence: Synthetic light chain variable domain
DILLEQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4171 - protein, 107 aa, Artificial Sequence
  Description of Artificial Sequence: Synthetic light chain variable domain
DILLEQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4172 - protein, 107 aa, Artificial Sequence
  Description of Artificial Sequence: Synthetic light chain variable domain
DILLFQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4173 - protein, 107 aa, Artificial Sequence
  Description of Artificial Sequence: Synthetic light chain variable domain
DILLFQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4174 - protein, 107 aa, Artificial Sequence
  Description of Artificial Sequence: Synthetic light chain variable domain
DILLGQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4175 - protein, 107 aa, Artificial Sequence
  Description of Artificial Sequence: Synthetic light chain variable domain
DILLGQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4176 - protein, 107 aa, Artificial Sequence
  Description of Artificial Sequence: Synthetic light chain variable domain
DILLHQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4177 - protein, 107 aa, Artificial Sequence
  Description of Artificial Sequence: Synthetic light chain variable domain
DILLHQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4178 - protein, 107 aa, Artificial Sequence
  Description of Artificial Sequence: Synthetic light chain variable domain
DILLKQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4179 - protein, 107 aa, Artificial Sequence
  Description of Artificial Sequence: Synthetic light chain variable domain
DILLKQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4180 - protein, 107 aa, Artificial Sequence
  Description of Artificial Sequence: Synthetic light chain variable domain
DILLLQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4181 - protein, 107 aa, Artificial Sequence
  Description of Artificial Sequence: Synthetic light chain variable domain
DILLLQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4182 - protein, 107 aa, Artificial Sequence
  Description of Artificial Sequence: Synthetic light chain variable domain
DILLNQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4183 - protein, 107 aa, Artificial Sequence
  Description of Artificial Sequence: Synthetic light chain variable domain
DILLNQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4184 - protein, 107 aa, Artificial Sequence
  Description of Artificial Sequence: Synthetic light chain variable domain
DILLPQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4185 - protein, 107 aa, Artificial Sequence
  Description of Artificial Sequence: Synthetic light chain variable domain
DILLRQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4186 - protein, 107 aa, Artificial Sequence
  Description of Artificial Sequence: Synthetic light chain variable domain
DILLRQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4187 - protein, 107 aa, Artificial Sequence
  Description of Artificial Sequence: Synthetic light chain variable domain
DILLSQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4188 - protein, 107 aa, Artificial Sequence
  Description of Artificial Sequence: Synthetic light chain variable domain
DILLSQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4189 - protein, 107 aa, Artificial Sequence
  Description of Artificial Sequence: Synthetic light chain variable domain
DILLTQSPGTLSLSPGERATLSCRASQSIGTNIHWYQQKPGQAPRLLIKYASESISGIPDRFSGSGSGTDFTLTISRLEPEDFAVYYCQQNNNWPTTFGQGTKLEIK

SEQ ID NO: 4190 - protein, 107 aa, Artificial Sequence
  Description of Artificial Sequence: Synthetic light chain variable domain
DILLTQSPVILSVSPGERVSFSCAASQSIGTNIHWYQQRTNGSPRLLIKYASESISGIPSRFSGSGSGTDFTLSINSVESEDIADYYCQQNNNWPTTFGAGTKLELK

SEQ ID NO: 4191 - protein, 107 aa, Artificial Sequence
  Description of Artificial Sequence: Synthetic light chain variable domain
DILLTQSPVILSVSPGERVSFSCAASQSIGTNIHWYQQRTNGSPRLLIKYASESISGIPSRFSGSGSGTDFTLSINSVESEDIADYYCQQNNNWPTTFGQGTKLELK

SEQ ID NO: 4192 - protein, 107 aa, Artificial Sequence
  Description of Artificial Sequence: Synthetic light chain variable domain
DILLTQSPVILSVSPGERVSFSCCASQSIGTNIHWYQQRTNGSPRLLIKYASESISGIPSRFSGSGSGTDFTLSINSVESEDIADYYCQQNNNWPTTFGAGTKLELK

SEQ ID NO: 4193 - protein, 107 aa, Artificial Sequence
  Description of Artificial Sequence: Synthetic light chain variable domain
DILLTQSPVILSVSPGERVSFSCCASQSIGTNIHWYQQRTNGSPRLLIKYASESISGIPSRFSGSGSGTDFTLSINSVESEDIADYYCQQNNNWPTTFGQGTKLELK

SEQ ID NO: 4194 - protein, 107 aa, Artificial Sequence
  Description of Artificial Sequence: Synthetic light chain variable domain
DILLTQSPVILSVSPGERVSFSCFASQSIGTNIHWYQQRTNGSPRLLIKYASESISGIPSRFSGSGSGTDFTLSINSVESEDIADYYCQQNNNWPTTFGAGTKLELK

SEQ ID NO: 4195 - protein, 107 aa, Artificial Sequence
  Description of Artificial Sequence: Synthetic light chain variable domain
DILLTQSPVILSVSPGERVSFSCFASQSIGTNIHWYQQRTNGSPRLLIKYASESISGIPSRFSGSGSGTDFTLSINSVESEDIADYYCQQNNNWPTTFGQGTKLELK

SEQ ID NO: 4196 - protein, 107 aa, Artificial Sequence
  Description of Artificial Sequence: Synthetic light chain variable domain
DILLTQSPVILSVSPGERVSFSCGASQSIGTNIHWYQQRTNGSPRLLIKYASESISGIPSRFSGSGSGTDFTLSINSVESEDIADYYCQQNNNWPTTFGAGTKLELK

SEQ ID NO: 4197 - protein, 107 aa, Artificial Sequence
  Description of Artificial Sequence: Synthetic light chain variable domain
DILLTQSPVILSVSPGERVSFSCLASQSIGTNIHWYQQRTNGSPRLLIKYASESISGIPSRFSGSGSGTDFTLSINSVESEDIADYYCQQNNNWPTTFGAGTKLELK

SEQ ID NO: 4198 - protein, 107 aa, Artificial Sequence
  Description of Artificial Sequence: Synthetic light chain variable domain
DILLTQSPVILSVSPGERVSFSCLASQSIGTNIHWYQQRTNGSPRLLIKYASESISGIPSRFSGSGSGTDFTLSINSVESEDIADYYCQQNNNWPTTFGQGTKLELK

SEQ ID NO: 4199 - protein, 107 aa, Artificial Sequence
  Description of Artificial Sequence: Synthetic light chain variable domain
DILLTQSPVILSVSPGERVSFSCMASQSIGTNIHWYQQRTNGSPRLLIKYASESISGIPSRFSGSGSGTDFTLSINSVESEDIADYYCQQNNNWPTTFGAGTKLELK

SEQ ID NO: 4200 - protein, 107 aa, Artificial Sequence
  Description of Artificial Sequence: Synthetic light chain variable domain
DILLTQSPVILSVSPGERVSFSCMASQSIGTNIHWYQQRTNGSPRLLIKYASESISGIPSRFSGSGSGTDFTLSINSVESEDIADYYCQQNNNWPTTFGQGTKLELK

SEQ ID NO: 4201 - protein, 107 aa, Artificial Sequence
  Description of Artificial Sequence: Synthetic light chain variable domain
DILLTQSPVILSVSPGERVSFSCRAAQSIGTNIHWYQQRTNGSPRLLIKYASESISGIPSRFSGSGSGTDFTLSINSVESEDIADYYCQQNNNWPTTFGAGTKLELK

SEQ ID NO: 4202 - protein, 107 aa, Artificial Sequence
  Description of Artificial Sequence: Synthetic light chain variable domain
DILLTQSPVILSVSPGERVSFSCRAAQSIGTNIHWYQQRTNGSPRLLIKYASESISGIPSRFSGSGSGTDFTLSINSVESEDIADYYCQQNNNWPTTFGQGTKLELK

SEQ ID NO: 4203 - protein, 107 aa, Artificial Sequence
  Description of Artificial Sequence: Synthetic light chain variable domain
DILLTQSPVILSVSPGERVSFSCRACQSIGTNIHWYQQRTNGSPRLLIKYASESISGIPSRFSGSGSGTDFTLSINSVESEDIADYYCQQNNNWPTTFGAGTKLELK

SEQ ID NO: 4204 - protein, 107 aa, Artificial Sequence
  Description of Artificial Sequence: Synthetic light chain variable domain
DILLTQSPVILSVSPGERVSFSCRACQSIGTNIHWYQQRTNGSPRLLIKYASESISGIPSRFSGSGSGTDFTLSINSVESEDIADYYCQQNNNWPTTFGQGTKLELK

SEQ ID NO: 4205 - protein, 107 aa, Artificial Sequence
  Description of Artificial Sequence: Synthetic light chain variable domain
DILLTQSPVILSVSPGERVSFSCRADQSIGTNIHWYQQRTNGSPRLLIKYASESISGIPSRFSGSGSGTDFTLSINSVESEDIADYYCQQNNNWPTTFGAGTKLELK

SEQ ID NO: 4206 - protein, 107 aa, Artificial Sequence
  Description of Artificial Sequence: Synthetic light chain variable domain
DILLTQSPVILSVSPGERVSFSCRADQSIGTNIHWYQQRTNGSPRLLIKYASESISGIPSRFSGSGSGTDFTLSINSVESEDIADYYCQQNNNWPTTFGQGTKLELK

SEQ ID NO: 4207 - protein, 107 aa, Artificial Sequence
  Description of Artificial Sequence: Synthetic light chain variable domain
DILLTQSPVILSVSPGERVSFSCRAGQSIGTNIHWYQQRTNGSPRLLIKYASESISGIPSRFSGSGSGTDFTLSINSVESEDIADYYCQQNNNWPTTFGAGTKLELK

SEQ ID NO: 4208 - protein, 107 aa, Artificial Sequence
  Description of Artificial Sequence: Synthetic light chain variable domain
DILLTQSPVILSVSPGERVSFSCRAGQSIGTNIHWYQQRTNGSPRLLIKYASESISGIPSRFSGSGSGTDFTLSINSVESEDIADYYCQQNNNWPTTFGQGTKLELK

SEQ ID NO: 4209 - protein, 107 aa, Artificial Sequence
  Description of Artificial Sequence: Synthetic light chain variable domain
DILLTQSPVILSVSPGERVSFSCRAHQSIGTNIHWYQQRTNGSPRLLIKYASESISGIPSRFSGSGSGTDFTLSINSVESEDIADYYCQQNNNWPTTFGAGTKLELK

SEQ ID NO: 4210 - protein, 107 aa, Artificial Sequence
  Description of Artificial Sequence: Synthetic light chain variable domain
DILLTQSPVILSVSPGERVSFSCRAHQSIGTNIHWYQQRTNGSPRLLIKYASESISGIPSRFSGSGSGTDFTLSINSVESEDIADYYCQQNNNWPTTFGQGTKLELK

SEQ ID NO: 4211 - protein, 107 aa, Artificial Sequence
  Description of Artificial Sequence: Synthetic light chain variable domain
DILLTQSPVILSVSPGERVSFSCRAIQSIGTNIHWYQQRTNGSPRLLIKYASESISGIPSRFSGSGSGTDFTLSINSVESEDIADYYCQQNNNWPTTFGAGTKLELK

SEQ ID NO: 4212 - protein, 107 aa, Artificial Sequence
  Description of Artificial Sequence: Synthetic light chain variable domain
DILLTQSPVILSVSPGERVSFSCRAIQSIGTNIHWYQQRTNGSPRLLIKYASESISGIPSRFSGSGSGTDFTLSINSVESEDIADYYCQQNNNWPTTFGQGTKLELK

SEQ ID NO: 4213 - protein, 107 aa, Artificial Sequence
  Description of Artificial Sequence: Synthetic light chain variable domain
DILLTQSPVILSVSPGERVSFSCRALQSIGTNIHWYQQRTNGSPRLLIKYASESISGIPSRFSGSGSGTDFTLSINSVESEDIADYYCQQNNNWPTTFGAGTKLELK

SEQ ID NO: 4214 - protein, 107 aa, Artificial Sequence
  Description of Artificial Sequence: Synthetic light chain variable domain
DILLTQSPVILSVSPGERVSFSCRALQSIGTNIHWYQQRTNGSPRLLIKYASESISGIPSRFSGSGSGTDFTLSINSVESEDIADYYCQQNNNWPTTFGQGTKLELK

SEQ ID NO: 4215 - protein, 107 aa, Artificial Sequence
  Description of Artificial Sequence: Synthetic light chain variable domain
DILLTQSPVILSVSPGERVSFSCRAMQSIGTNIHWYQQRTNGSPRLLIKYASESISGIPSRFSGSGSGTDFTLSINSVESEDIADYYCQQNNNWPTTFGAGTKLELK

SEQ ID NO: 4216 - protein, 107 aa, Artificial Sequence
  Description of Artificial Sequence: Synthetic light chain variable domain
DILLTQSPVILSVSPGERVSFSCRAMQSIGTNIHWYQQRTNGSPRLLIKYASESISGIPSRFSGSGSGTDFTLSINSVESEDIADYYCQQNNNWPTTFGQGTKLELK

SEQ ID NO: 4217 - protein, 107 aa, Artificial Sequence
  Description of Artificial Sequence: Synthetic light chain variable domain
DILLTQSPVILSVSPGERVSFSCRANQSIGTNIHWYQQRTNGSPRLLIKYASESISGIPSRFSGSGSGTDFTLSINSVESEDIADYYCQQNNNWPTTFGAGTKLELK

SEQ ID NO: 4218 - protein, 107 aa, Artificial Sequence
  Description of Artificial Sequence: Synthetic light chain variable domain
DILLTQSPVILSVSPGERVSFSCRANQSIGTNIHWYQQRTNGSPRLLIKYASESISGIPSRFSGSGSGTDFTLSINSVESEDIADYYCQQNNNWPTTFGQGTKLELK

SEQ ID NO: 4219 - protein, 107 aa, Artificial Sequence
  Description of Artificial Sequence: Synthetic light chain variable domain
DILLTQSPVILSVSPGERVSFSCRARQSIGTNIHWYQQRTNGSPRLLIKYASESISGIPSRFSGSGSGTDFTLSINSVESEDIADYYCQQNNNWPTTFGAGTKLELK

SEQ ID NO: 4220 - protein, 107 aa, Artificial Sequence
  Description of Artificial Sequence: Synthetic light chain variable domain
DILLTQSPVILSVSPGERVSFSCRARQSIGTNIHWYQQRTNGSPRLLIKYASESISGIPSRFSGSGSGTDFTLSINSVESEDIADYYCQQNNNWPTTFGQGTKLELK

SEQ ID NO: 4221 - protein, 107 aa, Artificial Sequence
  Description of Artificial Sequence: Synthetic light chain variable domain
DILLTQSPVILSVSPGERVSFSCRASASIGTNIHWYQQRTNGSPRLLIKYASESISGIPSRFSGSGSGTDFTLSINSVESEDIADYYCQQNNNWPTTFGAGTKLELK

SEQ ID NO: 4222 - protein, 107 aa, Artificial Sequence
  Description of Artificial Sequence: Synthetic light chain variable domain
DILLTQSPVILSVSPGERVSFSCRASASIGTNIHWYQQRTNGSPRLLIKYASESISGIPSRFSGSGSGTDFTLSINSVESEDIADYYCQQNNNWPTTFGQGTKLELK

SEQ ID NO: 4223 - protein, 107 aa, Artificial Sequence
  Description of Artificial Sequence: Synthetic light chain variable domain
DILLTQSPVILSVSPGERVSFSCRASDSIGTNIHWYQQRTNGSPRLLIKYASESISGIPSRFSGSGSGTDFTLSINSVESEDIADYYCQQNNNWPTTFGAGTKLELK

SEQ ID NO: 4224 - protein, 107 aa, Artificial Sequence
  Description of Artificial Sequence: Synthetic light chain variable domain
DILLTQSPVILSVSPGERVSFSCRASDSIGTNIHWYQQRTNGSPRLLIKYASESISGIPSRFSGSGSGTDFTLSINSVESEDIADYYCQQNNNWPTTFGQGTKLELK

SEQ ID NO: 4225 - protein, 107 aa, Artificial Sequence
  Description of Artificial Sequence: Synthetic light chain variable domain
DILLTQSPVILSVSPGERVSFSCRASESIGTNIHWYQQRTNGSPRLLIKYASESISGIPSRFSGSGSGTDFTLSINSVESEDIADYYCQQNNNWPTTFGAGTKLELK

SEQ ID NO: 4226 - protein, 107 aa, Artificial Sequence
  Description of Artificial Sequence: Synthetic light chain variable domain
DILLTQSPVILSVSPGERVSFSCRASESIGTNIHWYQQRTNGSPRLLIKYASESISGIPSRFSGSGSGTDFTLSINSVESEDIADYYCQQNNNWPTTFGQGTKLELK

SEQ ID NO: 4227 - protein, 107 aa, Artificial Sequence
  Description of Artificial Sequence: Synthetic light chain variable domain
DILLTQSPVILSVSPGERVSFSCRASFSIGTNIHWYQQRTNGSPRLLIKYASESISGIPSRFSGSGSGTDFTLSINSVESEDIADYYCQQNNNWPTTFGAGTKLELK

SEQ ID NO: 4228 - protein, 107 aa, Artificial Sequence
  Description of Artificial Sequence: Synthetic light chain variable domain
DILLTQSPVILSVSPGERVSFSCRASFSIGTNIHWYQQRTNGSPRLLIKYASESISGIPSRFSGSGSGTDFTLSINSVESEDIADYYCQQNNNWPTTFGQGTKLELK

SEQ ID NO: 4229 - protein, 107 aa, Artificial Sequence
  Description of Artificial Sequence: Synthetic light chain variable domain
DILLTQSPVILSVSPGERVSFSCRASISIGTNIHWYQQRTNGSPRLLIKYASESISGIPSRFSGSGSGTDFTLSINSVESEDIADYYCQQNNNWPTTFGAGTKLELK

SEQ ID NO: 4230 - protein, 107 aa, Artificial Sequence
  Description of Artificial Sequence: Synthetic light chain variable domain
DILLTQSPVILSVSPGERVSFSCRASISIGTNIHWYQQRTNGSPRLLIKYASESISGIPSRFSGSGSGTDFTLSINSVESEDIADYYCQQNNNWPTTFGQGTKLELK

SEQ ID NO: 4231 - protein, 107 aa, Artificial Sequence
  Description of Artificial Sequence: Synthetic light chain variable domain
DILLTQSPVILSVSPGERVSFSCRASMSIGTNIHWYQQRTNGSPRLLIKYASESISGIPSRFSGSGSGTDFTLSINSVESEDIADYYCQQNNNWPTTFGAGTKLELK

SEQ ID NO: 4232 - protein, 107 aa, Artificial Sequence
  Description of Artificial Sequence: Synthetic light chain variable domain
DILLTQSPVILSVSPGERVSFSCRASMSIGTNIHWYQQRTNGSPRLLIKYASESISGIPSRFSGSGSGTDFTLSINSVESEDIADYYCQQNNNWPTTFGQGTKLELK

SEQ ID NO: 4233 - protein, 107 aa, Artificial Sequence
  Description of Artificial Sequence: Synthetic light chain variable domain
DILLTQSPVILSVSPGERVSFSCRASNSIGTNIHWYQQRTNGSPRLLIKYASESISGIPSRFSGSGSGTDFTLSINSVESEDIADYYCQQNNNWPTTFGAGTKLELK

SEQ ID NO: 4234 - protein, 107 aa, Artificial Sequence
  Description of Artificial Sequence: Synthetic light chain variable domain
DILLTQSPVILSVSPGERVSFSCRASNSIGTNIHWYQQRTNGSPRLLIKYASESISGIPSRFSGSGSGTDFTLSINSVESEDIADYYCQQNNNWPTTFGQGTKLELK

SEQ ID NO: 4235 - protein, 107 aa, Artificial Sequence
  Description of Artificial Sequence: Synthetic light chain variable domain
DILLTQSPVILSVSPGERVSFSCRASPSIGTNIHWYQQRTNGSPRLLIKYASESISGIPSRFSGSGSGTDFTLSINSVESEDIADYYCQQNNNWPTTFGAGTKLELK

SEQ ID NO: 4236 - protein, 107 aa, Artificial Sequence
  Description of Artificial Sequence: Synthetic light chain variable domain
DILLTQSPVILSVSPGERVSFSCRASPSIGTNIHWYQQRTNGSPRLLIKYASESISGIPSRFSGSGSGTDFTLSINSVESEDIADYYCQQNNNWPTTFGQGTKLELK

SEQ ID NO: 4237 - protein, 107 aa, Artificial Sequence
  Description of Artificial Sequence: Synthetic light chain variable domain
DILLTQSPVILSVSPGERVSFSCRASQAIGTNIHWYQQRTNGSPRLLIKYASESISGIPSRFSGSGSGTDFTLSINSVESEDIADYYCQQNNNWPTTFGAGTKLELK

SEQ ID NO: 4238 - protein, 107 aa, Artificial Sequence
  Description of Artificial Sequence: Synthetic light chain variable domain
DILLTQSPVILSVSPGERVSFSCRASQAIGTNIHWYQQRTNGSPRLLIKYASESISGIPSRFSGSGSGTDFTLSINSVESEDIADYYCQQNNNWPTTFGQGTKLELK

SEQ ID NO: 4239 - protein, 107 aa, Artificial Sequence
  Description of Artificial Sequence: Synthetic light chain variable domain
DILLTQSPVILSVSPGERVSFSCRASQDIGTNIHWYQQRTNGSPRLLIKYASESISGIPSRFSGSGSGTDFTLSINSVESEDIADYYCQQNNNWPTTFGAGTKLELK

SEQ ID NO: 4240 - protein, 107 aa, Artificial Sequence
  Description of Artificial Sequence: Synthetic light chain variable domain
DILLTQSPVILSVSPGERVSFSCRASQDIGTNIHWYQQRTNGSPRLLIKYASESISGIPSRFSGSGSGTDFTLSINSVESEDIADYYCQQNNNWPTTFGQGTKLELK

SEQ ID NO: 4241 - protein, 107 aa, Artificial Sequence
  Description of Artificial Sequence: Synthetic light chain variable domain
DILLTQSPVILSVSPGERVSFSCRASQHIGTNIHWYQQRTNGSPRLLIKYASESISGIPSRFSGSGSGTDFTLSINSVESEDIADYYCQQNNNWPTTFGAGTKLELK

SEQ ID NO: 4242 - protein, 107 aa, Artificial Sequence
  Description of Artificial Sequence: Synthetic light chain variable domain
DILLTQSPVILSVSPGERVSFSCRASQHIGTNIHWYQQRTNGSPRLLIKYASESISGIPSRFSGSGSGTDFTLSINSVESEDIADYYCQQNNNWPTTFGQGTKLELK

SEQ ID NO: 4243 - protein, 107 aa, Artificial Sequence
  Description of Artificial Sequence: Synthetic light chain variable domain
DILLTQSPVILSVSPGERVSFSCRASQKIGTNIHWYQQRTNGSPRLLIKYASESISGIPSRFSGSGSGTDFTLSINSVESEDIADYYCQQNNNWPTTFGAGTKLELK

SEQ ID NO: 4244 - protein, 107 aa, Artificial Sequence
  Description of Artificial Sequence: Synthetic light chain variable domain
DILLTQSPVILSVSPGERVSFSCRASQKIGTNIHWYQQRTNGSPRLLIKYASESISGIPSRFSGSGSGTDFTLSINSVESEDIADYYCQQNNNWPTTFGQGTKLELK

SEQ ID NO: 4245 - protein, 107 aa, Artificial Sequence
  Description of Artificial Sequence: Synthetic light chain variable domain
DILLTQSPVILSVSPGERVSFSCRASQLIGTNIHWYQQRTNGSPRLLIKYASESISGIPSRFSGSGSGTDFTLSINSVESEDIADYYCQQNNNWPTTFGAGTKLELK

SEQ ID NO: 4246 - protein, 107 aa, Artificial Sequence
  Description of Artificial Sequence: Synthetic light chain variable domain
DILLTQSPVILSVSPGERVSFSCRASQLIGTNIHWYQQRTNGSPRLLIKYASESISGIPSRFSGSGSGTDFTLSINSVESEDIADYYCQQNNNWPTTFGQGTKLELK

SEQ ID NO: 4247 - protein, 107 aa, Artificial Sequence
  Description of Artificial Sequence: Synthetic light chain variable domain
DILLTQSPVILSVSPGERVSFSCRASQNIGTNIHWYQQRTNGSPRLLIKYASESISGIPSRFSGSGSGTDFTLSINSVESEDIADYYCQQNNNWPTTFGAGTKLELK

SEQ ID NO: 4248 - protein, 107 aa, Artificial Sequence
  Description of Artificial Sequence: Synthetic light chain variable domain
DILLTQSPVILSVSPGERVSFSCRASQNIGTNIHWYQQRTNGSPRLLIKYASESISGIPSRFSGSGSGTDFTLSINSVESEDIADYYCQQNNNWPTTFGQGTKLELK

SEQ ID NO: 4249 - protein, 107 aa, Artificial Sequence
  Description of Artificial Sequence: Synthetic light chain variable domain
DILLTQSPVILSVSPGERVSFSCRASQQIGTNIHWYQQRTNGSPRLLIKYASESISGIPSRFSGSGSGTDFTLSINSVESEDIADYYCQQNNNWPTTFGAGTKLELK

SEQ ID NO: 4250 - protein, 107 aa, Artificial Sequence
  Description of Artificial Sequence: Synthetic light chain variable domain
DILLTQSPVILSVSPGERVSFSCRASQQIGTNIHWYQQRTNGSPRLLIKYASESISGIPSRFSGSGSGTDFTLSINSVESEDIADYYCQQNNNWPTTFGQGTKLELK

SEQ ID NO: 4251 - protein, 107 aa, Artificial Sequence
  Description of Artificial Sequence: Synthetic light chain variable domain
DILLTQSPVILSVSPGERVSFSCRASQSAGTNIHWYQQRTNGSPRLLIKYASESISGIPSRFSGSGSGTDFTLSINSVESEDIADYYCQQNNNWPTTFGAGTKLELK

SEQ ID NO: 4252 - protein, 107 aa, Artificial Sequence
  Description of Artificial Sequence: Synthetic light chain variable domain
DILLTQSPVILSVSPGERVSFSCRASQSAGTNIHWYQQRTNGSPRLLIKYASESISGIPSRFSGSGSGTDFTLSINSVESEDIADYYCQQNNNWPTTFGQGTKLELK

SEQ ID NO: 4253 - protein, 107 aa, Artificial Sequence
  Description of Artificial Sequence: Synthetic light chain variable domain
DILLTQSPVILSVSPGERVSFSCRASQSEGTNIHWYQQRTNGSPRLLIKYASESISGIPSRFSGSGSGTDFTLSINSVESEDIADYYCQQNNNWPTTFGAGTKLELK

SEQ ID NO: 4254 - protein, 107 aa, Artificial Sequence
  Description of Artificial Sequence: Synthetic light chain variable domain
DILLTQSPVILSVSPGERVSFSCRASQSEGTNIHWYQQRTNGSPRLLIKYASESISGIPSRFSGSGSGTDFTLSINSVESEDIADYYCQQNNNWPTTFGQGTKLELK

SEQ ID NO: 4255 - protein, 107 aa, Artificial Sequence
  Description of Artificial Sequence: Synthetic light chain variable domain
DILLTQSPVILSVSPGERVSFSCRASQSFGTNIHWYQQRTNGSPRLLIKYASESISGIPSRFSGSGSGTDFTLSINSVESEDIADYYCQQNNNWPTTFGAGTKLELK

SEQ ID NO: 4256 - protein, 107 aa, Artificial Sequence
  Description of Artificial Sequence: Synthetic light chain variable domain
DILLTQSPVILSVSPGERVSFSCRASQSFGTNIHWYQQRTNGSPRLLIKYASESISGIPSRFSGSGSGTDFTLSINSVESEDIADYYCQQNNNWPTTFGQGTKLELK

SEQ ID NO: 4257 - protein, 107 aa, Artificial Sequence
  Description of Artificial Sequence: Synthetic light chain variable domain
DILLTQSPVILSVSPGERVSFSCRASQSIATNIHWYQQRTNGSPRLLIKYASESISGIPSRFSGSGSGTDFTLSINSVESEDIADYYCQQNNNWPTTFGAGTKLELK

SEQ ID NO: 4258 - protein, 107 aa, Artificial Sequence
  Description of Artificial Sequence: Synthetic light chain variable domain
DILLTQSPVILSVSPGERVSFSCRASQSIATNIHWYQQRTNGSPRLLIKYASESISGIPSRFSGSGSGTDFTLSINSVESEDIADYYCQQNNNWPTTFGQGTKLELK

SEQ ID NO: 4259 - protein, 107 aa, Artificial Sequence
  Description of Artificial Sequence: Synthetic light chain variable domain
DILLTQSPVILSVSPGERVSFSCRASQSIETNIHWYQQRTNGSPRLLIKYASESISGIPSRFSGSGSGTDFTLSINSVESEDIADYYCQQNNNWPTTFGAGTKLELK

SEQ ID NO: 4260 - protein, 107 aa, Artificial Sequence
  Description of Artificial Sequence: Synthetic light chain variable domain
DILLTQSPVILSVSPGERVSFSCRASQSIETNIHWYQQRTNGSPRLLIKYASESISGIPSRFSGSGSGTDFTLSINSVESEDIADYYCQQNNNWPTTFGQGTKLELK

SEQ ID NO: 4261 - protein, 107 aa, Artificial Sequence
  Description of Artificial Sequence: Synthetic light chain variable domain
DILLTQSPVILSVSPGERVSFSCRASQSIFTNIHWYQQRTNGSPRLLIKYASESISGIPSRFSGSGSGTDFTLSINSVESEDIADYYCQQNNNWPTTFGAGTKLELK

SEQ ID NO: 4262 - protein, 107 aa, Artificial Sequence
  Description of Artificial Sequence: Synthetic light chain variable domain
DILLTQSPVILSVSPGERVSFSCRASQSIFTNIHWYQQRTNGSPRLLIKYASESISGIPSRFSGSGSGTDFTLSINSVESEDIADYYCQQNNNWPTTFGQGTKLELK

SEQ ID NO: 4263 - protein, 107 aa, Artificial Sequence
  Description of Artificial Sequence: Synthetic light chain variable domain
DILLTQSPVILSVSPGERVSFSCRASQSIGANIHWYQQRTNGSPRLLIKYASESISGIPSRFSGSGSGTDFTLSINSVESEDIADYYCQQNNNWPTTFGAGTKLELK

SEQ ID NO: 4264 - protein, 107 aa, Artificial Sequence
  Description of Artificial Sequence: Synthetic light chain variable domain
DILLTQSPVILSVSPGERVSFSCRASQSIGANIHWYQQRTNGSPRLLIKYASESISGIPSRFSGSGSGTDFTLSINSVESEDIADYYCQQNNNWPTTFGQGTKLELK

SEQ ID NO: 4265 - protein, 107 aa, Artificial Sequence
  Description of Artificial Sequence: Synthetic light chain variable domain
DILLTQSPVILSVSPGERVSFSCRASQSIGFNIHWYQQRTNGSPRLLIKYASESISGIPSRFSGSGSGTDFTLSINSVESEDIADYYCQQNNNWPTTFGAGTKLELK

SEQ ID NO: 4266 - protein, 107 aa, Artificial Sequence
  Description of Artificial Sequence: Synthetic light chain variable domain
DILLTQSPVILSVSPGERVSFSCRASQSIGFNIHWYQQRTNGSPRLLIKYASESISGIPSRFSGSGSGTDFTLSINSVESEDIADYYCQQNNNWPTTFGQGTKLELK

SEQ ID NO: 4267 - protein, 107 aa, Artificial Sequence
  Description of Artificial Sequence: Synthetic light chain variable domain
DILLTQSPVILSVSPGERVSFSCRASQSIGGNIHWYQQRTNGSPRLLIKYASESISGIPSRFSGSGSGTDFTLSINSVESEDIADYYCQQNNNWPTTFGAGTKLELK

SEQ ID NO: 4268 - protein, 107 aa, Artificial Sequence
  Description of Artificial Sequence: Synthetic light chain variable domain
DILLTQSPVILSVSPGERVSFSCRASQSIGGNIHWYQQRTNGSPRLLIKYASESISGIPSRFSGSGSGTDFTLSINSVESEDIADYYCQQNNNWPTTFGQGTKLELK

SEQ ID NO: 4269 - protein, 107 aa, Artificial Sequence
  Description of Artificial Sequence: Synthetic light chain variable domain
DILLTQSPVILSVSPGERVSFSCRASQSIGHNIHWYQQRTNGSPRLLIKYASESISGIPSRFSGSGSGTDFTLSINSVESEDIADYYCQQNNNWPTTFGAGTKLELK

SEQ ID NO: 4270 - protein, 107 aa, Artificial Sequence
  Description of Artificial Sequence: Synthetic light chain variable domain
DILLTQSPVILSVSPGERVSFSCRASQSIGHNIHWYQQRTNGSPRLLIKYASESISGIPSRFSGSGSGTDFTLSINSVESEDIADYYCQQNNNWPTTFGQGTKLELK

SEQ ID NO: 4271 - protein, 107 aa, Artificial Sequence
  Description of Artificial Sequence: Synthetic light chain variable domain
DILLTQSPVILSVSPGERVSFSCRASQSIGKNIHWYQQRTNGSPRLLIKYASESISGIPSRFSGSGSGTDFTLSINSVESEDIADYYCQQNNNWPTTFGAGTKLELK

SEQ ID NO: 4272 - protein, 107 aa, Artificial Sequence
  Description of Artificial Sequence: Synthetic light chain variable domain
DILLTQSPVILSVSPGERVSFSCRASQSIGKNIHWYQQRTNGSPRLLIKYASESISGIPSRFSGSGSGTDFTLSINSVESEDIADYYCQQNNNWPTTFGQGTKLELK

SEQ ID NO: 4273 - protein, 107 aa, Artificial Sequence
  Description of Artificial Sequence: Synthetic light chain variable domain
DILLTQSPVILSVSPGERVSFSCRASQSIGLNIHWYQQRTNGSPRLLIKYASESISGIPSRFSGSGSGTDFTLSINSVESEDIADYYCQQNNNWPTTFGAGTKLELK

SEQ ID NO: 4274 - protein, 107 aa, Artificial Sequence
  Description of Artificial Sequence: Synthetic light chain variable domain
DILLTQSPVILSVSPGERVSFSCRASQSIGLNIHWYQQRTNGSPRLLIKYASESISGIPSRFSGSGSGTDFTLSINSVESEDIADYYCQQNNNWPTTFGQGTKLELK

SEQ ID NO: 4275 - protein, 107 aa, Artificial Sequence
  Description of Artificial Sequence: Synthetic light chain variable domain
DILLTQSPVILSVSPGERVSFSCRASQSIGMNIHWYQQRTNGSPRLLIKYASESISGIPSRFSGSGSGTDFTLSINSVESEDIADYYCQQNNNWPTTFGAGTKLELK

SEQ ID NO: 4276 - protein, 107 aa, Artificial Sequence
  Description of Artificial Sequence: Synthetic light chain variable domain
DILLTQSPVILSVSPGERVSFSCRASQSIGMNIHWYQQRTNGSPRLLIKYASESISGIPSRFSGSGSGTDFTLSINSVESEDIADYYCQQNNNWPTTFGQGTKLELK

SEQ ID NO: 4277 - protein, 107 aa, Artificial Sequence
  Description of Artificial Sequence: Synthetic light chain variable domain
DILLTQSPVILSVSPGERVSFSCRASQSIGSNIHWYQQRTNGSPRLLIKYASESISGIPSRFSGSGSGTDFTLSINSVESEDIADYYCQQNNNWPTTFGAGTKLELK

SEQ ID NO: 4278 - protein, 107 aa, Artificial Sequence
  Description of Artificial Sequence: Synthetic light chain variable domain
DILLTQSPVILSVSPGERVSFSCRASQSIGSNIHWYQQRTNGSPRLLIKYASESISGIPSRFSGSGSGTDFTLSINSVESEDIADYYCQQNNNWPTTFGQGTKLELK

SEQ ID NO: 4279 - protein, 107 aa, Artificial Sequence
  Description of Artificial Sequence: Synthetic light chain variable domain
DILLTQSPVILSVSPGERVSFSCRASQSIGTGIHWYQQRTNGSPRLLIKYASESISGIPSRFSGSGSGTDFTLSINSVESEDIADYYCQQNNNWPTTFGAGTKLELK

SEQ ID NO: 4280 - protein, 107 aa, Artificial Sequence
  Description of Artificial Sequence: Synthetic light chain variable domain
DILLTQSPVILSVSPGERVSFSCRASQSIGTGIHWYQQRTNGSPRLLIKYASESISGIPSRFSGSGSGTDFTLSINSVESEDIADYYCQQNNNWPTTFGQGTKLELK

SEQ ID NO: 4281 - protein, 107 aa, Artificial Sequence
  Description of Artificial Sequence: Synthetic light chain variable domain
DILLTQSPVILSVSPGERVSFSCRASQSIGTNFHWYQQRTNGSPRLLIKYASESISGIPSRFSGSGSGTDFTLSINSVESEDIADYYCQQNNNWPTTFGAGTKLELK

SEQ ID NO: 4282 - protein, 107 aa, Artificial Sequence
  Description of Artificial Sequence: Synthetic light chain variable domain
DILLTQSPVILSVSPGERVSFSCRASQSIGTNFHWYQQRTNGSPRLLIKYASESISGIPSRFSGSGSGTDFTLSINSVESEDIADYYCQQNNNWPTTFGQGTKLELK

SEQ ID NO: 4283 - protein, 107 aa, Artificial Sequence
  Description of Artificial Sequence: Synthetic light chain variable domain
DILLTQSPVILSVSPGERVSFSCRASQSIGTNGHWYQQRTNGSPRLLIKYASESISGIPSRFSGSGSGTDFTLSINSVESEDIADYYCQQNNNWPTTFGAGTKLELK

SEQ ID NO: 4284 - protein, 107 aa, Artificial Sequence
  Description of Artificial Sequence: Synthetic light chain variable domain
DILLTQSPVILSVSPGERVSFSCRASQSIGTNGHWYQQRTNGSPRLLIKYASESISGIPSRFSGSGSGTDFTLSINSVESEDIADYYCQQNNNWPTTFGQGTKLELK

SEQ ID NO: 4285 - protein, 107 aa, Artificial Sequence
  Description of Artificial Sequence: Synthetic light chain variable domain
DILLTQSPVILSVSPGERVSFSCRASQSIGTNHHWYQQRTNGSPRLLIKYASESISGIPSRFSGSGSGTDFTLSINSVESEDIADYYCQQNNNWPTTFGAGTKLELK

SEQ ID NO: 4286 - protein, 107 aa, Artificial Sequence
  Description of Artificial Sequence: Synthetic light chain variable domain
DILLTQSPVILSVSPGERVSFSCRASQSIGTNHHWYQQRTNGSPRLLIKYASESISGIPSRFSGSGSGTDFTLSINSVESEDIADYYCQQNNNWPTTFGQGTKLELK

SEQ ID NO: 4287 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIAYASESISGIPSRFSGSGSGTDFTLSINSVESEDIADYYCQQNNNWPTTFGAGTKLELK

SEQ ID NO: 4288 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIAYASESISGIPSRFSGSGSGTDFTLSINSVESEDIADYYCQQNNNWPTTFGQGTKLELK

SEQ ID NO: 4289 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIEYASESISGIPSRFSGSGSGTDFTLSINSVESEDIADYYCQQNNNWPTTFGAGTKLELK

SEQ ID NO: 4290 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIEYASESISGIPSRFSGSGSGTDFTLSINSVESEDIADYYCQQNNNWPTTFGQGTKLELK

SEQ ID NO: 4291 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIFYASESISGIPSRFSGSGSGTDFTLSINSVESEDIADYYCQQNNNWPTTFGAGTKLELK

SEQ ID NO: 4292 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIFYASESISGIPSRFSGSGSGTDFTLSINSVESEDIADYYCQQNNNWPTTFGQGTKLELK

SEQ ID NO: 4293 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIGYASESISGIPSRFSGSGSGTDFTLSINSVESEDIADYYCQQNNNWPTTFGAGTKLELK

SEQ ID NO: 4294 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIGYASESISGIPSRFSGSGSGTDFTLSINSVESEDIADYYCQQNNNWPTTFGQGTKLELK

SEQ ID NO: 4295 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIHYASESISGIPSRFSGSGSGTDFTLSINSVESEDIADYYCQQNNNWPTTFGAGTKLELK

SEQ ID NO: 4296 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIHYASESISGIPSRFSGSGSGTDFTLSINSVESEDIADYYCQQNNNWPTTFGQGTKLELK

SEQ ID NO: 4297 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAAESISGIPSRFSGSGSGTDFTLSINSVESEDIADYYCQQNNNWPTTFGAGTKLELK

SEQ ID NO: 4298 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAAESISGIPSRFSGSGSGTDFTLSINSVESEDIADYYCQQNNNWPTTFGQGTKLELK

SEQ ID NO: 4299 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYACESISGIPSRFSGSGSGTDFTLSINSVESEDIADYYCQQNNNWPTTFGAGTKLELK

SEQ ID NO: 4300 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYACESISGIPSRFSGSGSGTDFTLSINSVESEDIADYYCQQNNNWPTTFGQGTKLELK

SEQ ID NO: 4301 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYADESISGIPSRFSGSGSGTDFTLSINSVESEDIADYYCQQNNNWPTTFGAGTKLELK

SEQ ID NO: 4302 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYADESISGIPSRFSGSGSGTDFTLSINSVESEDIADYYCQQNNNWPTTFGQGTKLELK

SEQ ID NO: 4303 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAEESISGIPSRFSGSGSGTDFTLSINSVESEDIADYYCQQNNNWPTTFGAGTKLELK

SEQ ID NO: 4304 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAEESISGIPSRFSGSGSGTDFTLSINSVESEDIADYYCQQNNNWPTTFGQGTKLELK

SEQ ID NO: 4305 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAGESISGIPSRFSGSGSGTDFTLSINSVESEDIADYYCQQNNNWPTTFGAGTKLELK

SEQ ID NO: 4306 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAGESISGIPSRFSGSGSGTDFTLSINSVESEDIADYYCQQNNNWPTTFGQGTKLELK

SEQ ID NO: 4307 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAIESISGIPSRFSGSGSGTDFTLSINSVESEDIADYYCQQNNNWPTTFGAGTKLELK

SEQ ID NO: 4308 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAIESISGIPSRFSGSGSGTDFTLSINSVESEDIADYYCQQNNNWPTTFGQGTKLELK

SEQ ID NO: 4309 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAKESISGIPSRFSGSGSGTDFTLSINSVESEDIADYYCQQNNNWPTTFGAGTKLELK

SEQ ID NO: 4310 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAKESISGIPSRFSGSGSGTDFTLSINSVESEDIADYYCQQNNNWPTTFGQGTKLELK

SEQ ID NO: 4311 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAMESISGIPSRFSGSGSGTDFTLSINSVESEDIADYYCQQNNNWPTTFGAGTKLELK

SEQ ID NO: 4312 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAMESISGIPSRFSGSGSGTDFTLSINSVESEDIADYYCQQNNNWPTTFGQGTKLELK

SEQ ID NO: 4313 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAQESISGIPSRFSGSGSGTDFTLSINSVESEDIADYYCQQNNNWPTTFGAGTKLELK

SEQ ID NO: 4314 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAQESISGIPSRFSGSGSGTDFTLSINSVESEDIADYYCQQNNNWPTTFGQGTKLELK

SEQ ID NO: 4315 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYARESISGIPSRFSGSGSGTDFTLSINSVESEDIADYYCQQNNNWPTTFGAGTKLELK

SEQ ID NO: 4316 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYARESISGIPSRFSGSGSGTDFTLSINSVESEDIADYYCQQNNNWPTTFGQGTKLELK

SEQ ID NO: 4317 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASEMISGIPSRFSGSGSGTDFTLSINSVESEDIADYYCQQNNNWPTTFGAGTKLELK

SEQ ID NO: 4318 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASEMISGIPSRFSGSGSGTDFTLSINSVESEDIADYYCQQNNNWPTTFGQGTKLELK

SEQ ID NO: 4319 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESASGIPSRFSGSGSGTDFTLSINSVESEDIADYYCQQNNNWPTTFGAGTKLELK

SEQ ID NO: 4320 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESASGIPSRFSGSGSGTDFTLSINSVESEDIADYYCQQNNNWPTTFGQGTKLELK

SEQ ID NO: 4321 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESFSGIPSRFSGSGSGTDFTLSINSVESEDIADYYCQQNNNWPTTFGAGTKLELK

SEQ ID NO: 4322 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESFSGIPSRFSGSGSGTDFTLSINSVESEDIADYYCQQNNNWPTTFGQGTKLELK

SEQ ID NO: 4323 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIAGIPSRFSGSGSGTDFTLSINSVESEDIADYYCQQNNNWPTTFGAGTKLELK

SEQ ID NO: 4324 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIAGIPSRFSGSGSGTDFTLSINSVESEDIADYYCQQNNNWPTTFGQGTKLELK

SEQ ID NO: 4325 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESICGIPSRFSGSGSGTDFTLSINSVESEDIADYYCQQNNNWPTTFGAGTKLELK

SEQ ID NO: 4326 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESICGIPSRFSGSGSGTDFTLSINSVESEDIADYYCQQNNNWPTTFGQGTKLELK

SEQ ID NO: 4327 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIDGIPSRFSGSGSGTDFTLSINSVESEDIADYYCQQNNNWPTTFGAGTKLELK

SEQ ID NO: 4328 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIDGIPSRFSGSGSGTDFTLSINSVESEDIADYYCQQNNNWPTTFGQGTKLELK

SEQ ID NO: 4329 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIEGIPSRFSGSGSGTDFTLSINSVESEDIADYYCQQNNNWPTTFGAGTKLELK

SEQ ID NO: 4330 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIEGIPSRFSGSGSGTDFTLSINSVESEDIADYYCQQNNNWPTTFGQGTKLELK

SEQ ID NO: 4331 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIFGIPSRFSGSGSGTDFTLSINSVESEDIADYYCQQNNNWPTTFGAGTKLELK

SEQ ID NO: 4332 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIFGIPSRFSGSGSGTDFTLSINSVESEDIADYYCQQNNNWPTTFGQGTKLELK

SEQ ID NO: 4333 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIGGIPSRFSGSGSGTDFTLSINSVESEDIADYYCQQNNNWPTTFGAGTKLELK

SEQ ID NO: 4334 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIGGIPSRFSGSGSGTDFTLSINSVESEDIADYYCQQNNNWPTTFGQGTKLELK

SEQ ID NO: 4335 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIHGIPSRFSGSGSGTDFTLSINSVESEDIADYYCQQNNNWPTTFGAGTKLELK

SEQ ID NO: 4336 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIHGIPSRFSGSGSGTDFTLSINSVESEDIADYYCQQNNNWPTTFGQGTKLELK

SEQ ID NO: 4337 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIKGIPSRFSGSGSGTDFTLSINSVESEDIADYYCQQNNNWPTTFGAGTKLELK

SEQ ID NO: 4338 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIKGIPSRFSGSGSGTDFTLSINSVESEDIADYYCQQNNNWPTTFGQGTKLELK

SEQ ID NO: 4339 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESILGIPSRFSGSGSGTDFTLSINSVESEDIADYYCQQNNNWPTTFGAGTKLELK

SEQ ID NO: 4340 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESILGIPSRFSGSGSGTDFTLSINSVESEDIADYYCQQNNNWPTTFGQGTKLELK

SEQ ID NO: 4341 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESINGIPSRFSGSGSGTDFTLSINSVESEDIADYYCQQNNNWPTTFGAGTKLELK

SEQ ID NO: 4342 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESINGIPSRFSGSGSGTDFTLSINSVESEDIADYYCQQNNNWPTTFGQGTKLELK

SEQ ID NO: 4343 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIPGIPSRFSGSGSGTDFTLSINSVESEDIADYYCQQNNNWPTTFGAGTKLELK

SEQ ID NO: 4344 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIPGIPSRFSGSGSGTDFTLSINSVESEDIADYYCQQNNNWPTTFGQGTKLELK

SEQ ID NO: 4345 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIQGIPSRFSGSGSGTDFTLSINSVESEDIADYYCQQNNNWPTTFGAGTKLELK

SEQ ID NO: 4346 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIQGIPSRFSGSGSGTDFTLSINSVESEDIADYYCQQNNNWPTTFGQGTKLELK

SEQ ID NO: 4347 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIRGIPSRFSGSGSGTDFTLSINSVESEDIADYYCQQNNNWPTTFGAGTKLELK

SEQ ID NO: 4348 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIRGIPSRFSGSGSGTDFTLSINSVESEDIADYYCQQNNNWPTTFGQGTKLELK

SEQ ID NO: 4349 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADFYCQQNNNWPTTFGAGTKLELK

SEQ ID NO: 4350 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADFYCQQNNNWPTTFGQGTKLELK

SEQ ID NO: 4351 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADHYCQQNNNWPTTFGAGTKLELK

SEQ ID NO: 4352 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADHYCQQNNNWPTTFGQGTKLELK

SEQ ID NO: 4353 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADMYCQQNNNWPTTFGAGTKLELK

SEQ ID NO: 4354 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADMYCQQNNNWPTTFGQGTKLELK

SEQ ID NO: 4355 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYCCQQNNNWPTTFGAGTKLELK

SEQ ID NO: 4356 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYCCQQNNNWPTTFGQGTKLELK

SEQ ID NO: 4357 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYDCQQNNNWPTTFGAGTKLELK

SEQ ID NO: 4358 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYDCQQNNNWPTTFGQGTKLELK

SEQ ID NO: 4359 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYFCQQNNNWPTTFGAGTKLELK

SEQ ID NO: 4360 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYFCQQNNNWPTTFGQGTKLELK

SEQ ID NO: 4361 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYGCQQNNNWPTTFGAGTKLELK

SEQ ID NO: 4362 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYGCQQNNNWPTTFGQGTKLELK

SEQ ID NO: 4363 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYHCQQNNNWPTTFGAGTKLELK

SEQ ID NO: 4364 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYHCQQNNNWPTTFGQGTKLELK

SEQ ID NO: 4365 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYICQQNNNWPTTFGAGTKLELK

SEQ ID NO: 4366 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYICQQNNNWPTTFGQGTKLELK

SEQ ID NO: 4367 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYKCQQNNNWPTTFGAGTKLELK

SEQ ID NO: 4368 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYKCQQNNNWPTTFGQGTKLELK

SEQ ID NO: 4369 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYLCQQNNNWPTTFGAGTKLELK

SEQ ID NO: 4370 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYLCQQNNNWPTTFGQGTKLELK

SEQ ID NO: 4371 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYNCQQNNNWPTTFGAGTKLELK

SEQ ID NO: 4372 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYNCQQNNNWPTTFGQGTKLELK

SEQ ID NO: 4373 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYPCQQNNNWPTTFGAGTKLELK

SEQ ID NO: 4374 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYPCQQNNNWPTTFGQGTKLELK

SEQ ID NO: 4375 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYRCQQNNNWPTTFGAGTKLELK

SEQ ID NO: 4376 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYRCQQNNNWPTTFGQGTKLELK

SEQ ID NO: 4377 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYSCQQNNNWPTTFGAGTKLELK

SEQ ID NO: 4378 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYSCQQNNNWPTTFGQGTKLELK

SEQ ID NO: 4379 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYTCQQNNNWPTTFGAGTKLELK

SEQ ID NO: 4380 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYTCQQNNNWPTTFGQGTKLELK

SEQ ID NO: 4381 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYVCQQNNNWPTTFGAGTKLELK

SEQ ID NO: 4382 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYVCQQNNNWPTTFGQGTKLELK

SEQ ID NO: 4383 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYWCQQNNNWPTTFGAGTKLELK

SEQ ID NO: 4384 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYWCQQNNNWPTTFGQGTKLELK

SEQ ID NO: 4385 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCEQNNNWPTTFGAGTKLELK

SEQ ID NO: 4386 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCEQNNNWPTTFGQGTKLELK

SEQ ID NO: 4387 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQANNWPTTFGAGTKLELK

SEQ ID NO: 4388 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQANNWPTTFGQGTKLELK

SEQ ID NO: 4389 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQCNNWPTTFGAGTKLELK

SEQ ID NO: 4390 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQCNNWPTTFGQGTKLELK

SEQ ID NO: 4391 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQHNNWPTTFGAGTKLELK

SEQ ID NO: 4392 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQHNNWPTTFGQGTKLELK

SEQ ID NO: 4393 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQINNWPTTFGAGTKLELK

SEQ ID NO: 4394 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQINNWPTTFGQGTKLELK

SEQ ID NO: 4395 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQLNNWPTTFGAGTKLELK

SEQ ID NO: 4396 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQLNNWPTTFGQGTKLELK

SEQ ID NO: 4397 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQMNNWPTTFGAGTKLELK

SEQ ID NO: 4398 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQMNNWPTTFGQGTKLELK

SEQ ID NO: 4399 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNCNWPTTFGAGTKLELK

SEQ ID NO: 4400 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNCNWPTTFGQGTKLELK

SEQ ID NO: 4401 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNDNWPTTFGAGTKLELK

SEQ ID NO: 4402 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNDNWPTTFGQGTKLELK

SEQ ID NO: 4403 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNHNWPTTFGAGTKLELK

SEQ ID NO: 4404 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNHNWPTTFGQGTKLELK

SEQ ID NO: 4405 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNKNWPTTFGAGTKLELK

SEQ ID NO: 4406 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNKNWPTTFGQGTKLELK

SEQ ID NO: 4407 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNLNWPTTFGAGTKLELK

SEQ ID NO: 4408 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNLNWPTTFGQGTKLELK

SEQ ID NO: 4409 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNMNWPTTFGAGTKLELK

SEQ ID NO: 4410 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNMNWPTTFGQGTKLELK

SEQ ID NO: 4411 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPCTFGAGTKLELK

SEQ ID NO: 4412 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPCTFGQGTKLELK

SEQ ID NO: 4413 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPLTFGAGTKLELK

SEQ ID NO: 4414 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPLTFGQGTKLELK

SEQ ID NO: 4415 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPMTFGAGTKLELK

SEQ ID NO: 4416 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPMTFGQGTKLELK

SEQ ID NO: 4417 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTAFGAGTKLELK

SEQ ID NO: 4418 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTAFGQGTKLELK

SEQ ID NO: 4419 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTDFGAGTKLELK

SEQ ID NO: 4420 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTDFGQGTKLELK

SEQ ID NO: 4421 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTGFGAGTKLELK

SEQ ID NO: 4422 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTGFGQGTKLELK

SEQ ID NO: 4423 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTKFGAGTKLELK

SEQ ID NO: 4424 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTKFGQGTKLELK

SEQ ID NO: 4425 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTLFGAGTKLELK

SEQ ID NO: 4426 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTLFGQGTKLELK

SEQ ID NO: 4427 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTQFGAGTKLELK

SEQ ID NO: 4428 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTQFGQGTKLELK

SEQ ID NO: 4429 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTRFGAGTKLELK

SEQ ID NO: 4430 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTRFGQGTKLELK

SEQ ID NO: 4431 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTSFGAGTKLELK

SEQ ID NO: 4432 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTSFGQGTKLELK

SEQ ID NO: 4433 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTAGAGTKLELK

SEQ ID NO: 4434 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTAGQGTKLELK

SEQ ID NO: 4435 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFDAGTKLELK

SEQ ID NO: 4436 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFDQGTKLELK

SEQ ID NO: 4437 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFEAGTKLELK

SEQ ID NO: 4438 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFEQGTKLELK

SEQ ID NO: 4439 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFFAGTKLELK

SEQ ID NO: 4440 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFFQGTKLELK

SEQ ID NO: 4441 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGDGTKLELK

SEQ ID NO: 4442 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGEGTKLELK

SEQ ID NO: 4443 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGFGTKLELK

SEQ ID NO: 4444 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGHGTKLELK

SEQ ID NO: 4445 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGIGTKLELK

SEQ ID NO: 4446 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGKGTKLELK

SEQ ID NO: 4447 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGMGTKLELK

SEQ ID NO: 4448 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGNGTKLELK

SEQ ID NO: 4449 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGPGTKLELK

SEQ ID NO: 4450 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGRGTKLELK

SEQ ID NO: 4451 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGTGTKLELK

SEQ ID NO: 4452 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGVGTKLELK

SEQ ID NO: 4453 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGWGTKLELK

SEQ ID NO: 4454 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGYGTKLELK

SEQ ID NO: 4455 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFHAGTKLELK

SEQ ID NO: 4456 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFHQGTKLELK

SEQ ID NO: 4457 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFIAGTKLELK

SEQ ID NO: 4458 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFIQGTKLELK

SEQ ID NO: 4459 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFKAGTKLELK

SEQ ID NO: 4460 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFKQGTKLELK

SEQ ID NO: 4461 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFLAGTKLELK

SEQ ID NO: 4462 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFLQGTKLELK

SEQ ID NO: 4463 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFMAGTKLELK

SEQ ID NO: 4464 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFMQGTKLELK

SEQ ID NO: 4465 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFNAGTKLELK

SEQ ID NO: 4466 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFNQGTKLELK

SEQ ID NO: 4467 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFSAGTKLELK

SEQ ID NO: 4468 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFSQGTKLELK

SEQ ID NO: 4469 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFTAGTKLELK

SEQ ID NO: 4470 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFTQGTKLELK

SEQ ID NO: 4471 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFVAGTKLELK

SEQ ID NO: 4472 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFVQGTKLELK

SEQ ID NO: 4473 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTMGAGTKLELK

SEQ ID NO: 4474 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTMGQGTKLELK

SEQ ID NO: 4475 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTSGAGTKLELK

SEQ ID NO: 4476 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTSGQGTKLELK

SEQ ID NO: 4477 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTVGAGTKLELK

SEQ ID NO: 4478 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTVGQGTKLELK

SEQ ID NO: 4479 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTYGAGTKLELK

SEQ ID NO: 4480 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTYGQGTKLELK

SEQ ID NO: 4481 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTVFGAGTKLELK

SEQ ID NO: 4482 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTVFGQGTKLELK

SEQ ID NO: 4483 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPVTFGAGTKLELK

SEQ ID NO: 4484 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPVTFGQGTKLELK

SEQ ID NO: 4485 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNTWPTTFGAGTKLELK

SEQ ID NO: 4486 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNTWPTTFGQGTKLELK

SEQ ID NO: 4487 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNRNWPTTFGAGTKLELK

SEQ ID NO: 4488 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNRNWPTTFGQGTKLELK

SEQ ID NO: 4489 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNSNWPTTFGAGTKLELK

SEQ ID NO: 4490 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNSNWPTTFGQGTKLELK

SEQ ID NO: 4491 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNTNWPTTFGAGTKLELK

SEQ ID NO: 4492 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNTNWPTTFGQGTKLELK

SEQ ID NO: 4493 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNVNWPTTFGAGTKLELK

SEQ ID NO: 4494 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNVNWPTTFGQGTKLELK

SEQ ID NO: 4495 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNWNWPTTFGAGTKLELK

SEQ ID NO: 4496 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNWNWPTTFGQGTKLELK

SEQ ID NO: 4497 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNYNWPTTFGAGTKLELK

SEQ ID NO: 4498 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQNYNWPTTFGQGTKLELK

SEQ ID NO: 4499 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQRNNWPTTFGAGTKLELK

SEQ ID NO: 4500 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQRNNWPTTFGQGTKLELK

SEQ ID NO: 4501 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQSNNWPTTFGAGTKLELK

SEQ ID NO: 4502 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQSNNWPTTFGQGTKLELK

SEQ ID NO: 4503 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQTNNWPTTFGAGTKLELK

SEQ ID NO: 4504 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQTNNWPTTFGQGTKLELK

SEQ ID NO: 4505 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQVNNWPTTFGAGTKLELK

SEQ ID NO: 4506 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESISGIPSRFSGSGSGTDFTLSINSVESEDIADYYCQQVNNWPTTFGQGTKLELK

SEQ ID NO: 4507 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIVGIPSRFSGSGSGTDFTLSINSVESEDIADYYCQQNNNWPTTFGAGTKLELK

SEQ ID NO: 4508 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIVGIPSRFSGSGSGTDFTLSINSVESEDIADYYCQQNNNWPTTFGQGTKLELK

SEQ ID NO: 4509 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIWGIPSRFSGSGSGTDFTLSINSVESEDIADYYCQQNNNWPTTFGAGTKLELK

SEQ ID NO: 4510 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASESIWGIPSRFSGSGSGTDFTLSINSVESEDIADYYCQQNNNWPTTFGQGTKLELK

SEQ ID NO: 4511 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASGSISGIPSRFSGSGSGTDFTLSINSVESEDIADYYCQQNNNWPTTFGAGTKLELK

SEQ ID NO: 4512 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYASGSISGIPSRFSGSGSGTDFTLSINSVESEDIADYYCQQNNNWPTTFGQGTKLELK

SEQ ID NO: 4513 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAVESISGIPSRFSGSGSGTDFTLSINSVESEDIADYYCQQNNNWPTTFGAGTKLELK

SEQ ID NO: 4514 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAVESISGIPSRFSGSGSGTDFTLSINSVESEDIADYYCQQNNNWPTTFGQGTKLELK

SEQ ID NO: 4515 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAWESISGIPSRFSGSGSGTDFTLSINSVESEDIADYYCQQNNNWPTTFGAGTKLELK

SEQ ID NO: 4516 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYAWESISGIPSRFSGSGSGTDFTLSINSVESEDIADYYCQQNNNWPTTFGQGTKLELK

SEQ ID NO: 4517 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYLSESISGIPSRFSGSGSGTDFTLSINSVESEDIADYYCQQNNNWPTTFGAGTKLELK

SEQ ID NO: 4518 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYLSESISGIPSRFSGSGSGTDFTLSINSVESEDIADYYCQQNNNWPTTFGQGTKLELK

SEQ ID NO: 4519 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYTSESISGIPSRFSGSGSGTDFTLSINSVESEDIADYYCQQNNNWPTTFGAGTKLELK

SEQ ID NO: 4520 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIKYTSESISGIPSRFSGSGSGTDFTLSINSVESEDIADYYCQQNNNWPTTFGQGTKLELK

SEQ ID NO: 4521 - protein, 107 aa, Artificial Sequence
  Description of Artificial Sequence: Synthetic light chain variable domain
DILLTQSPVILSVSPGERVSFSCRASQSIGTNIHWYQQRTNGSPRLLILYASESISGIPSRFSGSGSGTDFTLSINSVESEDIADYYCQQNNNWPTTFGAGTKLELK

SEQ ID NO: 4522 - protein, 107 aa, Artificial Sequence
  Description of Artificial Sequence: Synthetic light chain variable domain
DILLTQSPVILSVSPGERVSFSCRASQSIGTNIHWYQQRTNGSPRLLILYASESISGIPSRFSGSGSGTDFTLSINSVESEDIADYYCQQNNNWPTTFGQGTKLELK

SEQ ID NO: 4523 - protein, 107 aa, Artificial Sequence
  Description of Artificial Sequence: Synthetic light chain variable domain
DILLTQSPVILSVSPGERVSFSCRASQSIGTNIHWYQQRTNGSPRLLINYASESISGIPSRFSGSGSGTDFTLSINSVESEDIADYYCQQNNNWPTTFGAGTKLELK

SEQ ID NO: 4524 - protein, 107 aa, Artificial Sequence
  Description of Artificial Sequence: Synthetic light chain variable domain
DILLTQSPVILSVSPGERVSFSCRASQSIGTNIHWYQQRTNGSPRLLINYASESISGIPSRFSGSGSGTDFTLSINSVESEDIADYYCQQNNNWPTTFGQGTKLELK

SEQ ID NO: 4525 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIQYASESISGIPSRFSGSGSGTDFTLSINSVESEDIADYYCQQNNNWPTTFGAGTKLELK

SEQ ID NO: 4526 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIQYASESISGIPSRFSGSGSGTDFTLSINSVESEDIADYYCQQNNNWPTTFGQGTKLELK

SEQ ID NO: 4527 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIRYASESISGIPSRFSGSGSGTDFTLSINSVESEDIADYYCQQNNNWPTTFGAGTKLELK

SEQ ID NO: 4528 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIRYASESISGIPSRFSGSGSGTDFTLSINSVESEDIADYYCQQNNNWPTTFGQGTKLELK

SEQ ID NO: 4529 - protein, 107 aa, Artificial Sequence
  Description of Artificial Sequence: Synthetic light chain variable domain
DILLTQSPVILSVSPGERVSFSCRASQSIGTNIHWYQQRTNGSPRLLISYASESISGIPSRFSGSGSGTDFTLSINSVESEDIADYYCQQNNNWPTTFGAGTKLELK

SEQ ID NO: 4530 - protein, 107 aa, Artificial Sequence
  Description of Artificial Sequence: Synthetic light chain variable domain
DILLTQSPVILSVSPGERVSFSCRASQSIGTNIHWYQQRTNGSPRLLISYASESISGIPSRFSGSGSGTDFTLSINSVESEDIADYYCQQNNNWPTTFGQGTKLELK

SEQ ID NO: 4531 - protein, 107 aa, Artificial Sequence
  Description of Artificial Sequence: Synthetic light chain variable domain
DILLTQSPVILSVSPGERVSFSCRASQSIGTNIHWYQQRTNGSPRLLITYASESISGIPSRFSGSGSGTDFTLSINSVESEDIADYYCQQNNNWPTTFGAGTKLELK

SEQ ID NO: 4532 - protein, 107 aa, Artificial Sequence
  Description of Artificial Sequence: Synthetic light chain variable domain
DILLTQSPVILSVSPGERVSFSCRASQSIGTNIHWYQQRTNGSPRLLITYASESISGIPSRFSGSGSGTDFTLSINSVESEDIADYYCQQNNNWPTTFGQGTKLELK

SEQ ID NO: 4533 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIVYASESISGIPSRFSGSGSGTDFTLSINSVESEDIADYYCQQNNNWPTTFGAGTKLELK

SEQ ID NO: 4534 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIVYASESISGIPSRFSGSGSGTDFTLSINSVESEDIADYYCQQNNNWPTTFGQGTKLELK

SEQ ID NO: 4535 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIYYASESISGIPSRFSGSGSGTDFTLSINSVESEDIADYYCQQNNNWPTTFGAGTKLELK

SEQ ID NO: 4536 - protein, 107 aa, Artificial Sequence
  Description of Artificial Sequence: Synthetic light chain variable domain
DILLTQSPVILSVSPGERVSFSCRASQSIGTNIHWYQQRTNGSPRLLIYYASESISGIPSRFSGSGSGTDFTLSINSVESEDIADYYCQQNNNWPTTFGQGTKLELK

SEQ ID NO: 4537 - protein, 107 aa, Artificial Sequence
  Description of Artificial Sequence: Synthetic light chain variable domain
DILLTQSPVILSVSPGERVSFSCRASQSIGTNIHWYQQRTNGSPRLLKKYASESISGIPSRFSGSGSGTDFTLSINSVESEDIADYYCQQNNNWPTTFGAGTKLELK

SEQ ID NO: 4538 - protein, 107 aa, Artificial Sequence
  Description of Artificial Sequence: Synthetic light chain variable domain
DILLTQSPVILSVSPGERVSFSCRASQSIGTNIHWYQQRTNGSPRLLKKYASESISGIPSRFSGSGSGTDFTLSINSVESEDIADYYCQQNNNWPTTFGQGTKLELK

SEQ ID NO: 4539 - protein, 107 aa, Artificial Sequence
  Description of Artificial Sequence: Synthetic light chain variable domain
DILLTQSPVILSVSPGERVSFSCRASQSIGTNIHWYQQRTNGSPRLLLKYASESISGIPSRFSGSGSGTDFTLSINSVESEDIADYYCQQNNNWPTTFGAGTKLELK

SEQ ID NO: 4540 - protein, 107 aa, Artificial Sequence
  Description of Artificial Sequence: Synthetic light chain variable domain
DILLTQSPVILSVSPGERVSFSCRASQSIGTNIHWYQQRTNGSPRLLLKYASESISGIPSRFSGSGSGTDFTLSINSVESEDIADYYCQQNNNWPTTFGQGTKLELK

SEQ ID NO: 4541 - protein, 107 aa, Artificial Sequence
  Description of Artificial Sequence: Synthetic light chain variable domain
DILLTQSPVILSVSPGERVSFSCRASQSIGTNIHWYQQRTNGSPRLLMKYASESISGIPSRFSGSGSGTDFTLSINSVESEDIADYYCQQNNNWPTTFGAGTKLELK

SEQ ID NO: 4542 - protein, 107 aa, Artificial Sequence
  Description of Artificial Sequence: Synthetic light chain variable domain
DILLTQSPVILSVSPGERVSFSCRASQSIGTNIHWYQQRTNGSPRLLMKYASESISGIPSRFSGSGSGTDFTLSINSVESEDIADYYCQQNNNWPTTFGQGTKLELK

SEQ ID NO: 4543 - protein, 107 aa, Artificial Sequence
  Description of Artificial Sequence: Synthetic light chain variable domain
DILLTQSPVILSVSPGERVSFSCRASQSIGTNIHWYQQRTNGSPRLLSKYASESISGIPSRFSGSGSGTDFTLSINSVESEDIADYYCQQNNNWPTTFGAGTKLELK

SEQ ID NO: 4544 - protein, 107 aa, Artificial Sequence
  Description of Artificial Sequence: Synthetic light chain variable domain
DILLTQSPVILSVSPGERVSFSCRASQSIGTNIHWYQQRTNGSPRLLSKYASESISGIPSRFSGSGSGTDFTLSINSVESEDIADYYCQQNNNWPTTFGQGTKLELK

SEQ ID NO: 4545 - protein, 107 aa, Artificial Sequence
  Description of Artificial Sequence: Synthetic light chain variable domain
DILLTQSPVILSVSPGERVSFSCRASQSIGTNMHWYQQRTNGSPRLLIKYASESISGIPSRFSGSGSGTDFTLSINSVESEDIADYYCQQNNNWPTTFGAGTKLELK

SEQ ID NO: 4546 - protein, 107 aa, Artificial Sequence
  Description of Artificial Sequence: Synthetic light chain variable domain
DILLTQSPVILSVSPGERVSFSCRASQSIGTNMHWYQQRTNGSPRLLIKYASESISGIPSRFSGSGSGTDFTLSINSVESEDIADYYCQQNNNWPTTFGQGTKLELK

SEQ ID NO: 4547 - protein, 107 aa, Artificial Sequence
  Description of Artificial Sequence: Synthetic light chain variable domain
DILLTQSPVILSVSPGERVSFSCRASQSIGTNTHWYQQRTNGSPRLLIKYASESISGIPSRFSGSGSGTDFTLSINSVESEDIADYYCQQNNNWPTTFGAGTKLELK

SEQ ID NO: 4548 - protein, 107 aa, Artificial Sequence
  Description of Artificial Sequence: Synthetic light chain variable domain
DILLTQSPVILSVSPGERVSFSCRASQSIGTNTHWYQQRTNGSPRLLIKYASESISGIPSRFSGSGSGTDFTLSINSVESEDIADYYCQQNNNWPTTFGQGTKLELK

SEQ ID NO: 4549 - protein, 107 aa, Artificial Sequence
  Description of Artificial Sequence: Synthetic light chain variable domain
DILLTQSPVILSVSPGERVSFSCRASQSIGTNVHWYQQRTNGSPRLLIKYASESISGIPSRFSGSGSGTDFTLSINSVESEDIADYYCQQNNNWPTTFGAGTKLELK

SEQ ID NO: 4550 - protein, 107 aa, Artificial Sequence
  Description of Artificial Sequence: Synthetic light chain variable domain
DILLTQSPVILSVSPGERVSFSCRASQSIGTNVHWYQQRTNGSPRLLIKYASESISGIPSRFSGSGSGTDFTLSINSVESEDIADYYCQQNNNWPTTFGQGTKLELK

SEQ ID NO: 4551 - protein, 107 aa, Artificial Sequence
  Description of Artificial Sequence: Synthetic light chain variable domain
DILLTQSPVILSVSPGERVSFSCRASQSIGVNIHWYQQRTNGSPRLLIKYASESISGIPSRFSGSGSGTDFTLSINSVESEDIADYYCQQNNNWPTTFGAGTKLELK

SEQ ID NO: 4552 - protein, 107 aa, Artificial Sequence
  Description of Artificial Sequence: Synthetic light chain variable domain
DILLTQSPVILSVSPGERVSFSCRASQSIGVNIHWYQQRTNGSPRLLIKYASESISGIPSRFSGSGSGTDFTLSINSVESEDIADYYCQQNNNWPTTFGQGTKLELK

SEQ ID NO: 4553 - protein, 107 aa, Artificial Sequence
  Description of Artificial Sequence: Synthetic light chain variable domain
DILLTQSPVILSVSPGERVSFSCRASQSIGWNIHWYQQRTNGSPRLLIKYASESISGIPSRFSGSGSGTDFTLSINSVESEDIADYYCQQNNNWPTTFGAGTKLELK

SEQ ID NO: 4554 - protein, 107 aa, Artificial Sequence
  Description of Artificial Sequence: Synthetic light chain variable domain
DILLTQSPVILSVSPGERVSFSCRASQSIGWNIHWYQQRTNGSPRLLIKYASESISGIPSRFSGSGSGTDFTLSINSVESEDIADYYCQQNNNWPTTFGQGTKLELK

SEQ ID NO: 4555 - protein, 107 aa, Artificial Sequence
  Description of Artificial Sequence: Synthetic light chain variable domain
DILLTQSPVILSVSPGERVSFSCRASQSIHTNIHWYQQRTNGSPRLLIKYASESISGIPSRFSGSGSGTDFTLSINSVESEDIADYYCQQNNNWPTTFGAGTKLELK

SEQ ID NO: 4556 - protein, 107 aa, Artificial Sequence
  Description of Artificial Sequence: Synthetic light chain variable domain
DILLTQSPVILSVSPGERVSFSCRASQSIHTNIHWYQQRTNGSPRLLIKYASESISGIPSRFSGSGSGTDFTLSINSVESEDIADYYCQQNNNWPTTFGQGTKLELK

SEQ ID NO: 4557 - protein, 107 aa, Artificial Sequence
  Description of Artificial Sequence: Synthetic light chain variable domain
DILLTQSPVILSVSPGERVSFSCRASQSIITNIHWYQQRTNGSPRLLIKYASESISGIPSRFSGSGSGTDFTLSINSVESEDIADYYCQQNNNWPTTFGAGTKLELK

SEQ ID NO: 4558 - protein, 107 aa, Artificial Sequence
  Description of Artificial Sequence: Synthetic light chain variable domain
DILLTQSPVILSVSPGERVSFSCRASQSIITNIHWYQQRTNGSPRLLIKYASESISGIPSRFSGSGSGTDFTLSINSVESEDIADYYCQQNNNWPTTFGQGTKLELK

SEQ ID NO: 4559 - protein, 107 aa, Artificial Sequence
  Description of Artificial Sequence: Synthetic light chain variable domain
DILLTQSPVILSVSPGERVSFSCRASQSIKTNIHWYQQRTNGSPRLLIKYASESISGIPSRFSGSGSGTDFTLSINSVESEDIADYYCQQNNNWPTTFGAGTKLELK

SEQ ID NO: 4560 - protein, 107 aa, Artificial Sequence
  Description of Artificial Sequence: Synthetic light chain variable domain
DILLTQSPVILSVSPGERVSFSCRASQSIKTNIHWYQQRTNGSPRLLIKYASESISGIPSRFSGSGSGTDFTLSINSVESEDIADYYCQQNNNWPTTFGQGTKLELK

SEQ ID NO: 4561 - protein, 107 aa, Artificial Sequence
  Description of Artificial Sequence: Synthetic light chain variable domain
DILLTQSPVILSVSPGERVSFSCRASQSILTNIHWYQQRTNGSPRLLIKYASESISGIPSRFSGSGSGTDFTLSINSVESEDIADYYCQQNNNWPTTFGAGTKLELK

SEQ ID NO: 4562 - protein, 107 aa, Artificial Sequence
  Description of Artificial Sequence: Synthetic light chain variable domain
DILLTQSPVILSVSPGERVSFSCRASQSILTNIHWYQQRTNGSPRLLIKYASESISGIPSRFSGSGSGTDFTLSINSVESEDIADYYCQQNNNWPTTFGQGTKLELK

SEQ ID NO: 4563 - protein, 107 aa, Artificial Sequence
  Description of Artificial Sequence: Synthetic light chain variable domain
DILLTQSPVILSVSPGERVSFSCRASQSIMTNIHWYQQRTNGSPRLLIKYASESISGIPSRFSGSGSGTDFTLSINSVESEDIADYYCQQNNNWPTTFGAGTKLELK

SEQ ID NO: 4564 - protein, 107 aa, Artificial Sequence
  Description of Artificial Sequence: Synthetic light chain variable domain
DILLTQSPVILSVSPGERVSFSCRASQSIMTNIHWYQQRTNGSPRLLIKYASESISGIPSRFSGSGSGTDFTLSINSVESEDIADYYCQQNNNWPTTFGQGTKLELK

SEQ ID NO: 4565 - protein, 107 aa, Artificial Sequence
  Description of Artificial Sequence: Synthetic light chain variable domain
DILLTQSPVILSVSPGERVSFSCRASQSIPTNIHWYQQRTNGSPRLLIKYASESISGIPSRFSGSGSGTDFTLSINSVESEDIADYYCQQNNNWPTTFGAGTKLELK

SEQ ID NO: 4566 - protein, 107 aa, Artificial Sequence
  Description of Artificial Sequence: Synthetic light chain variable domain
DILLTQSPVILSVSPGERVSFSCRASQSIPTNIHWYQQRTNGSPRLLIKYASESISGIPSRFSGSGSGTDFTLSINSVESEDIADYYCQQNNNWPTTFGQGTKLELK

SEQ ID NO: 4567 - protein, 107 aa, Artificial Sequence
  Description of Artificial Sequence: Synthetic light chain variable domain
DILLTQSPVILSVSPGERVSFSCRASQSIQTNIHWYQQRTNGSPRLLIKYASESISGIPSRFSGSGSGTDFTLSINSVESEDIADYYCQQNNNWPTTFGAGTKLELK

SEQ ID NO: 4568 - protein, 107 aa, Artificial Sequence
  Description of Artificial Sequence: Synthetic light chain variable domain
DILLTQSPVILSVSPGERVSFSCRASQSIQTNIHWYQQRTNGSPRLLIKYASESISGIPSRFSGSGSGTDFTLSINSVESEDIADYYCQQNNNWPTTFGQGTKLELK

SEQ ID NO: 4569 - protein, 107 aa, Artificial Sequence
  Description of Artificial Sequence: Synthetic light chain variable domain
DILLTQSPVILSVSPGERVSFSCRASQSIRTNIHWYQQRTNGSPRLLIKYASESISGIPSRFSGSGSGTDFTLSINSVESEDIADYYCQQNNNWPTTFGAGTKLELK

SEQ ID NO: 4570 - protein, 107 aa, Artificial Sequence
  Description of Artificial Sequence: Synthetic light chain variable domain
DILLTQSPVILSVSPGERVSFSCRASQSIRTNIHWYQQRTNGSPRLLIKYASESISGIPSRFSGSGSGTDFTLSINSVESEDIADYYCQQNNNWPTTFGQGTKLELK

SEQ ID NO: 4571 - protein, 107 aa, Artificial Sequence
  Description of Artificial Sequence: Synthetic light chain variable domain
DILLTQSPVILSVSPGERVSFSCRASQSISTNIHWYQQRTNGSPRLLIKYASESISGIPSRFSGSGSGTDFTLSINSVESEDIADYYCQQNNNWPTTFGAGTKLELK

SEQ ID NO: 4572 - protein, 107 aa, Artificial Sequence
  Description of Artificial Sequence: Synthetic light chain variable domain
DILLTQSPVILSVSPGERVSFSCRASQSISTNIHWYQQRTNGSPRLLIKYASESISGIPSRFSGSGSGTDFTLSINSVESEDIADYYCQQNNNWPTTFGQGTKLELK

SEQ ID NO: 4573 - protein, 107 aa, Artificial Sequence
  Description of Artificial Sequence: Synthetic light chain variable domain
DILLTQSPVILSVSPGERVSFSCRASQSIVTNIHWYQQRTNGSPRLLIKYASESISGIPSRFSGSGSGTDFTLSINSVESEDIADYYCQQNNNWPTTFGAGTKLELK

SEQ ID NO: 4574 - protein, 107 aa, Artificial Sequence
  Description of Artificial Sequence: Synthetic light chain variable domain
DILLTQSPVILSVSPGERVSFSCRASQSIVTNIHWYQQRTNGSPRLLIKYASESISGIPSRFSGSGSGTDFTLSINSVESEDIADYYCQQNNNWPTTFGQGTKLELK

SEQ ID NO: 4575 - protein, 107 aa, Artificial Sequence
  Description of Artificial Sequence: Synthetic light chain variable domain
DILLTQSPVILSVSPGERVSFSCRASQSIYTNIHWYQQRTNGSPRLLIKYASESISGIPSRFSGSGSGTDFTLSINSVESEDIADYYCQQNNNWPTTFGAGTKLELK

SEQ ID NO: 4576 - protein, 107 aa, Artificial Sequence
  Description of Artificial Sequence: Synthetic light chain variable domain
DILLTQSPVILSVSPGERVSFSCRASQSIYTNIHWYQQRTNGSPRLLIKYASESISGIPSRFSGSGSGTDFTLSINSVESEDIADYYCQQNNNWPTTFGQGTKLELK

SEQ ID NO: 4577 - protein, 107 aa, Artificial Sequence
  Description of Artificial Sequence: Synthetic light chain variable domain
DILLTQSPVILSVSPGERVSFSCRASQSRGTNIHWYQQRTNGSPRLLIKYASESISGIPSRFSGSGSGTDFTLSINSVESEDIADYYCQQNNNWPTTFGAGTKLELK

SEQ ID NO: 4578 - protein, 107 aa, Artificial Sequence
  Description of Artificial Sequence: Synthetic light chain variable domain
DILLTQSPVILSVSPGERVSFSCRASQSRGTNIHWYQQRTNGSPRLLIKYASESISGIPSRFSGSGSGTDFTLSINSVESEDIADYYCQQNNNWPTTFGQGTKLELK

SEQ ID NO: 4579 - protein, 107 aa, Artificial Sequence
  Description of Artificial Sequence: Synthetic light chain variable domain
DILLTQSPVILSVSPGERVSFSCRASQSSGTNIHWYQQRTNGSPRLLIKYASESISGIPSRFSGSGSGTDFTLSINSVESEDIADYYCQQNNNWPTTFGAGTKLELK

SEQ ID NO: 4580 - protein, 107 aa, Artificial Sequence
  Description of Artificial Sequence: Synthetic light chain variable domain
DILLTQSPVILSVSPGERVSFSCRASQSSGTNIHWYQQRTNGSPRLLIKYASESISGIPSRFSGSGSGTDFTLSINSVESEDIADYYCQQNNNWPTTFGQGTKLELK

SEQ ID NO: 4581 - protein, 107 aa, Artificial Sequence
  Description of Artificial Sequence: Synthetic light chain variable domain
DILLTQSPVILSVSPGERVSFSCRASQSTGTNIHWYQQRTNGSPRLLIKYASESISGIPSRFSGSGSGTDFTLSINSVESEDIADYYCQQNNNWPTTFGAGTKLELK

SEQ ID NO: 4582 - protein, 107 aa, Artificial Sequence
  Description of Artificial Sequence: Synthetic light chain variable domain
DILLTQSPVILSVSPGERVSFSCRASQSTGTNIHWYQQRTNGSPRLLIKYASESISGIPSRFSGSGSGTDFTLSINSVESEDIADYYCQQNNNWPTTFGQGTKLELK

SEQ ID NO: 4583 - protein, 107 aa, Artificial Sequence
  Description of Artificial Sequence: Synthetic light chain variable domain
DILLTQSPVILSVSPGERVSFSCRASTSIGTNIHWYQQRTNGSPRLLIKYASESISGIPSRFSGSGSGTDFTLSINSVESEDIADYYCQQNNNWPTTFGAGTKLELK

SEQ ID NO: 4584 - protein, 107 aa, Artificial Sequence
  Description of Artificial Sequence: Synthetic light chain variable domain
DILLTQSPVILSVSPGERVSFSCRASTSIGTNIHWYQQRTNGSPRLLIKYASESISGIPSRFSGSGSGTDFTLSINSVESEDIADYYCQQNNNWPTTFGQGTKLELK

SEQ ID NO: 4585 - protein, 107 aa, Artificial Sequence
  Description of Artificial Sequence: Synthetic light chain variable domain
DILLTQSPVILSVSPGERVSFSCRAVQSIGTNIHWYQQRTNGSPRLLIKYASESISGIPSRFSGSGSGTDFTLSINSVESEDIADYYCQQNNNWPTTFGAGTKLELK

SEQ ID NO: 4586 - protein, 107 aa, Artificial Sequence
  Description of Artificial Sequence: Synthetic light chain variable domain
DILLTQSPVILSVSPGERVSFSCRAVQSIGTNIHWYQQRTNGSPRLLIKYASESISGIPSRFSGSGSGTDFTLSINSVESEDIADYYCQQNNNWPTTFGQGTKLELK

SEQ ID NO: 4587 - protein, 107 aa, Artificial Sequence
  Description of Artificial Sequence: Synthetic light chain variable domain
DILLTQSPVILSVSPGERVSFSCRAWQSIGTNIHWYQQRTNGSPRLLIKYASESISGIPSRFSGSGSGTDFTLSINSVESEDIADYYCQQNNNWPTTFGAGTKLELK

SEQ ID NO: 4588 - protein, 107 aa, Artificial Sequence
  Description of Artificial Sequence: Synthetic light chain variable domain
DILLTQSPVILSVSPGERVSFSCRAWQSIGTNIHWYQQRTNGSPRLLIKYASESISGIPSRFSGSGSGTDFTLSINSVESEDIADYYCQQNNNWPTTFGQGTKLELK

SEQ ID NO: 4589 - protein, 107 aa, Artificial Sequence
  Description of Artificial Sequence: Synthetic light chain variable domain
DILLTQSPVILSVSPGERVSFSCRCSQSIGTNIHWYQQRTNGSPRLLIKYASESISGIPSRFSGSGSGTDFTLSINSVESEDIADYYCQQNNNWPTTFGAGTKLELK

SEQ ID NO: 4590 - protein, 107 aa, Artificial Sequence
  Description of Artificial Sequence: Synthetic light chain variable domain
DILLTQSPVILSVSPGERVSFSCRCSQSIGTNIHWYQQRTNGSPRLLIKYASESISGIPSRFSGSGSGTDFTLSINSVESEDIADYYCQQNNNWPTTFGQGTKLELK

SEQ ID NO: 4591 - protein, 107 aa, Artificial Sequence
  Description of Artificial Sequence: Synthetic light chain variable domain
DILLTQSPVILSVSPGERVSFSCRGSQSIGTNIHWYQQRTNGSPRLLIKYASESISGIPSRFSGSGSGTDFTLSINSVESEDIADYYCQQNNNWPTTFGAGTKLELK

SEQ ID NO: 4592 - protein, 107 aa, Artificial Sequence
  Description of Artificial Sequence: Synthetic light chain variable domain
DILLTQSPVILSVSPGERVSFSCRGSQSIGTNIHWYQQRTNGSPRLLIKYASESISGIPSRFSGSGSGTDFTLSINSVESEDIADYYCQQNNNWPTTFGQGTKLELK

SEQ ID NO: 4593 - protein, 107 aa, Artificial Sequence
  Description of Artificial Sequence: Synthetic light chain variable domain
DILLTQSPVILSVSPGERVSFSCRLSQSIGTNIHWYQQRTNGSPRLLIKYASESISGIPSRFSGSGSGTDFTLSINSVESEDIADYYCQQNNNWPTTFGAGTKLELK

SEQ ID NO: 4594 - protein, 107 aa, Artificial Sequence
  Description of Artificial Sequence: Synthetic light chain variable domain
DILLTQSPVILSVSPGERVSFSCRLSQSIGTNIHWYQQRTNGSPRLLIKYASESISGIPSRFSGSGSGTDFTLSINSVESEDIADYYCQQNNNWPTTFGQGTKLELK

SEQ ID NO: 4595 - protein, 107 aa, Artificial Sequence
  Description of Artificial Sequence: Synthetic light chain variable domain
DILLTQSPVILSVSPGERVSFSCRVSQSIGTNIHWYQQRTNGSPRLLIKYASESISGIPSRFSGSGSGTDFTLSINSVESEDIADYYCQQNNNWPTTFGAGTKLELK

SEQ ID NO: 4596 - protein, 107 aa, Artificial Sequence
  Description of Artificial Sequence: Synthetic light chain variable domain
DILLTQSPVILSVSPGERVSFSCRVSQSIGTNIHWYQQRTNGSPRLLIKYASESISGIPSRFSGSGSGTDFTLSINSVESEDIADYYCQQNNNWPTTFGQGTKLELK

SEQ ID NO: 4597 - protein, 107 aa, Artificial Sequence
  Description of Artificial Sequence: Synthetic light chain variable domain
DILLTQSPVILSVSPGERVSFSCSASQSIGTNIHWYQQRTNGSPRLLIKYASESISGIPSRFSGSGSGTDFTLSINSVESEDIADYYCQQNNNWPTTFGAGTKLELK

SEQ ID NO: 4598 - protein, 107 aa, Artificial Sequence
  Description of Artificial Sequence: Synthetic light chain variable domain
DILLTQSPVILSVSPGERVSFSCSASQSIGTNIHWYQQRTNGSPRLLIKYASESISGIPSRFSGSGSGTDFTLSINSVESEDIADYYCQQNNNWPTTFGQGTKLELK

SEQ ID NO: 4599 - protein, 107 aa, Artificial Sequence
  Description of Artificial Sequence: Synthetic light chain variable domain
DILLTQSPVILSVSPGERVSFSCWASQSIGTNIHWYQQRTNGSPRLLIKYASESISGIPSRFSGSGSGTDFTLSINSVESEDIADYYCQQNNNWPTTFGAGTKLELK

SEQ ID NO: 4600 - protein, 107 aa, Artificial Sequence
  Description of Artificial Sequence: Synthetic light chain variable domain
DILLTQSPVILSVSPGERVSFSCWASQSIGTNIHWYQQRTNGSPRLLIKYASESISGIPSRFSGSGSGTDFTLSINSVESEDIADYYCQQNNNWPTTFGQGTKLELK

SEQ ID NO: 4601 - protein, 107 aa, Artificial Sequence
  Description of Artificial Sequence: Synthetic light chain variable domain
DILLTQSPVILSVSPGERVSFSCYASQSIGTNIHWYQQRTNGSPRLLIKYASESISGIPSRFSGSGSGTDFTLSINSVESEDIADYYCQQNNNWPTTFGAGTKLELK

SEQ ID NO: 4602 - protein, 107 aa, Artificial Sequence
  Description of Artificial Sequence: Synthetic light chain variable domain
DILLTQSPVILSVSPGERVSFSCYASQSIGTNIHWYQQRTNGSPRLLIKYASESISGIPSRFSGSGSGTDFTLSINSVESEDIADYYCQQNNNWPTTFGQGTKLELK

SEQ ID NO: 4603 - protein, 107 aa, Artificial Sequence
  Description of Artificial Sequence: Synthetic light chain variable domain
DILLWQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4604 - protein, 107 aa, Artificial Sequence
  Description of Artificial Sequence: Synthetic light chain variable domain
DILLWQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4605 - protein, 107 aa, Artificial Sequence
  Description of Artificial Sequence: Synthetic light chain variable domain
DILPTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4606 - protein, 107 aa, Artificial Sequence
  Description of Artificial Sequence: Synthetic light chain variable domain
DILPTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4607 - protein, 107 aa, Artificial Sequence
  Description of Artificial Sequence: Synthetic light chain variable domain
DILRTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4608 - protein, 107 aa, Artificial Sequence
  Description of Artificial Sequence: Synthetic light chain variable domain
DILRTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4609 - protein, 107 aa, Artificial Sequence
  Description of Artificial Sequence: Synthetic light chain variable domain
DILSTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4610 - protein, 107 aa, Artificial Sequence
  Description of Artificial Sequence: Synthetic light chain variable domain
DILSTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4611 - protein, 107 aa, Artificial Sequence
  Description of Artificial Sequence: Synthetic light chain variable domain
DILTTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4612 - protein, 107 aa, Artificial Sequence
  Description of Artificial Sequence: Synthetic light chain variable domain
DILTTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4613 - protein, 107 aa, Artificial Sequence
  Description of Artificial Sequence: Synthetic light chain variable domain
DILVTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4614 - protein, 107 aa, Artificial Sequence
  Description of Artificial Sequence: Synthetic light chain variable domain
DILVTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4615 - protein, 107 aa, Artificial Sequence
  Description of Artificial Sequence: Synthetic light chain variable domain
DILWTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4616 - protein, 107 aa, Artificial Sequence
  Description of Artificial Sequence: Synthetic light chain variable domain
DILWTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4617 - protein, 107 aa, Artificial Sequence
  Description of Artificial Sequence: Synthetic light chain variable domain
DIRLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4618 - protein, 107 aa, Artificial Sequence
  Description of Artificial Sequence: Synthetic light chain variable domain
DIRLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4619 - protein, 107 aa, Artificial Sequence
  Description of Artificial Sequence: Synthetic light chain variable domain
DISLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4620 - protein, 107 aa, Artificial Sequence
  Description of Artificial Sequence: Synthetic light chain variable domain
DISLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4621 - protein, 107 aa, Artificial Sequence
  Description of Artificial Sequence: Synthetic light chain variable domain
DITLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4622 - protein, 107 aa, Artificial Sequence
  Description of Artificial Sequence: Synthetic light chain variable domain
DITLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4623 - protein, 107 aa, Artificial Sequence
  Description of Artificial Sequence: Synthetic light chain variable domain
DIVLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4624 - protein, 107 aa, Artificial Sequence
  Description of Artificial Sequence: Synthetic light chain variable domain
DIVLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4625 - protein, 107 aa, Artificial Sequence
  Description of Artificial Sequence: Synthetic light chain variable domain
DIWLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4626 - protein, 107 aa, Artificial Sequence
  Description of Artificial Sequence: Synthetic light chain variable domain
DIWLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4627 - protein, 107 aa, Artificial Sequence
  Description of Artificial Sequence: Synthetic light chain variable domain
DIYLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4628 - protein, 107 aa, Artificial Sequence
  Description of Artificial Sequence: Synthetic light chain variable domain
DIYLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4629 - protein, 107 aa, Artificial Sequence
  Description of Artificial Sequence: Synthetic light chain variable domain
DVLLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4630 - protein, 107 aa, Artificial Sequence
  Description of Artificial Sequence: Synthetic light chain variable domain
DVLLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4631 - protein, 107 aa, Artificial Sequence
  Description of Artificial Sequence: Synthetic light chain variable domain
DWLLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4632 - protein, 107 aa, Artificial Sequence
  Description of Artificial Sequence: Synthetic light chain variable domain
DWLLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 4633 - protein, 119 aa, Artificial Sequence
  Description of Artificial Sequence: Synthetic light chain variable domain
  MOD_RES (58)..(58): Any amino acid
  MOD_RES (101)..(103): Any amino acid
  MOD_RES (105)..(105): Any amino acid
QVQLKQSGPGLVQPSQSLSITCTVSGFSLTNYGVHWVRQSPGKGLEWLGVIWSGGNTXYNTPFTSRLSINKDNSKSQVFFKMNSLQSNDTAIYYCARALTXXXYXFAYWGQGTLVTVSA

SEQ ID NO: 4634 - protein, 123 aa, Artificial Sequence
  Description of Artificial Sequence: Synthetic light chain variable domain
MDMRAPTQLLGLLLLWLPGATFAQVLTQTPSPVSAAVGSTVTIKCQSSPSVYSNYLSWYQQKSGQPPKQLIYDASHLASGVPSRFSGSGSGTQFTLTISGVQCDDAATYYCLGSYDCSSVDCH

SEQ ID NO: 4635 - protein, 108 aa, Artificial Sequence
  Description of Artificial Sequence: Synthetic light chain variable domain
DIQMTQSPSFLSASVGDRVTINCKASQNINNYLNWYQQKLGEAPKRLIYNTNNLQTGIPSRFSGSGSGTDYTLTISSLQPEDFATYFCLQHNSFPTFGAGTKLELKRT

SEQ ID NO: 4636 - protein, 108 aa, Artificial Sequence
  Description of Artificial Sequence: Synthetic light chain variable domain
DIQMTQSPSSLSASVGDRVTITCRASQGINNYLNWYQQKPGKAPKRLIYNTNNLQTGVPSRFSGSGSGTEFTLTISSLQPEDFATYYCLQHNSFPTFGQGTKLEIKRT

SEQ ID NO: 4637 - protein, 108 aa, Artificial Sequence
  Description of Artificial Sequence: Synthetic light chain variable domain
EIVLTQSPATLSLSPGERATLSCRASQSVSSYLAWYQQKPGQAPRLLIYDASKRATGIPARFSGSGSGTDFTLTISSLEPEDFAVYYCQQRSKWPPWTFGQGTKVESK

SEQ ID NO: 4638 - protein, 108 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSKWPPWTFGQGTKVEIK

SEQ ID NO: 4639 - protein, 108 aa, Artificial Sequence
  Description of Artificial Sequence: Synthetic light chain variable domain
DIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIKR

SEQ ID NO: 4640 - protein, 127 aa, Artificial Sequence
  Description of Artificial Sequence: Synthetic light chain variable domain
MDWTWRILFLVAAATGVHSDIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIKR

SEQ ID NO: 4641 - protein, 128 aa, Artificial Sequence
  Description of Artificial Sequence: Synthetic light chain variable domain
MVSTAQFLAFLLLWFPGARCDILMTQSPSSMSVSLGDTVSITCHSSQDINSNIGWLQQRPGKSFKGLIYHGTNLDDEVPSRFSGSGSGADYSLTISSLESEDFADYYCVQYAQFPWTFGGGTKLEIKR

SEQ ID NO: 4642 - protein, 107 aa, Artificial Sequence
  Description of Artificial Sequence: Synthetic light chain variable domain
AIQLTQSPSSLSASVGDRVTITCRASQGIGNDLGWYQLRPGKAPKLLIYATSSLQSGVPSRFSGSGSGTDFTLTISSLQPEDFATYYCLQDYNYPWTFGQGTKVEIK

SEQ ID NO: 4643 - protein, 107 aa, Artificial Sequence
  Description of Artificial Sequence: Synthetic light chain variable domain
AIQMTQSPSSLSASVGDRVTITCRASQGIGNDLGWYQQKPGKAPNLLIYATSSLQSGVPSRFSGSGSGTDFTLTISSLQPEDFATYYCLQDYNYPWTFGQGTKVEIK

SEQ ID NO: 4644 - protein, 107 aa, Artificial Sequence
  Description of Artificial Sequence: Synthetic light chain variable domain
AIQMTQSPSSLSASVGDRVTITCRASQGIGYDLGWYQQKPGKAPKLLIYAASSLQSGVPSRFSGSGSGTDFTLTISSLQPEDFATYYCLQDYNYPWTFGQGTKVDIK

SEQ ID NO: 4645 - protein, 107 aa, Artificial Sequence
  Description of Artificial Sequence: Synthetic light chain variable domain
DIQLTQSPSFLSASVGDRVTITCWASQGINNYLAWYQQKPGKAPKLLIYAASTLQTGVPSRFSGSGSGTEFTLTISSLQPEDFATYYCQQLNSYPLTFGGGTKVEIK

SEQ ID NO: 4646 - protein, 108 aa, Artificial Sequence
  Description of Artificial Sequence: Synthetic light chain variable domain
DIQMTQSPSSVSASVGDRVTITCRASQGISSWLAWYQQQPGKAPKLLIYAASSLQSGVPSRFSGSGSGTDFTLTISSLQPEDFATYYCQQTNSFPLTFGGGTKVEIKR

SEQ ID NO: 4647 - protein, 107 aa, Artificial Sequence
  Description of Artificial Sequence: Synthetic light chain variable domain
DIQMTQSPSTLSASVGDRVTITCRASQSTSSWLAWYQQKPGKAPTLLIYKASSLESGVPSKFSGSGSGTEFTLTISSLQPDDFATYYCQQYNRYSRTFGQGTKVEIK

SEQ ID NO: 4648 - protein, 114 aa, Artificial Sequence
  Description of Artificial Sequence: Synthetic light chain variable domain
DIVMTQSPDSLAVSLGERATINCKSSQSVLYSSNNKNYLAWYQHKPGQPPNLLIYWASTRESGVPDRFSGSGSGTDFTLTISSLQAEDVAVYYCHQYYSTPFTFGPGTKVDIKR

SEQ ID NO: 4649 - protein, 113 aa, Artificial Sequence
  Description of Artificial Sequence: Synthetic light chain variable domain
DVVMTQSPLSLPVALGQPASISCRSSQSLVYTDGNTYLNWFHQRPGQSPRRLIYKVSNRDSGVPDRFTGSGSGTDFTLKISRVEAEDVGVFYCMQGSHWPPYTFGQGTKLEIK

SEQ ID NO: 4650 - protein, 108 aa, Artificial Sequence
  Description of Artificial Sequence: Synthetic light chain variable domain
EIALTQSPGTLSLSPGERATLSCRASQSVSSTYLAWYQQKPGQAPRLLIYGASSRATGIPDRFSGSGSGTDFTLTISRLEPEDFAVYYCQQYDSSPITFGQGTRLEIK

SEQ ID NO: 4651 - protein, 112 aa, Artificial Sequence
  Description of Artificial Sequence: Synthetic light chain variable domain
AIVLTQTPLSSPVTLGQPASISCRSSQSLVHRDGNTYLSWLQQRPGQPPRLLIYKISNRFSGVPDRFSGSGAGTDFTLKISRVEPDDVGVYYCMHTTQLPWTFGQGTKVEIK

SEQ ID NO: 4652 - protein, 107 aa, Artificial Sequence
  Description of Artificial Sequence: Synthetic light chain variable domain
DIQMTQSPSSLSASVGDSVTITCRTSQGIRKNLGWYQQKPGKAPKRLIYAASSLQSGVPSRFSGSGSGTEFTLTISRLQPEDFATYYCLQHHSYPLTFGGGTRVEIR

SEQ ID NO: 4653 - protein, 112 aa, Artificial Sequence
  Description of Artificial Sequence: Synthetic light chain variable domain
DIVMTQSPLSLPVTPGEPASISCRSSQSLLYRNGNNYLDWYLQKPGQSPQLLIYLGSNRASGVPDRFSGSGSGTDFTLNISRVEAEDVGHYYCMQALQTPRTFGQGTKVEIK

SEQ ID NO: 4654 - protein, 112 aa, Artificial Sequence
  Description of Artificial Sequence: Synthetic light chain variable domain
DIVMTQSPLSLPVTPGEPASISCRSSQSLLYRNGNNYLDWYLQRPGQSPQLLIYLGSNRASGVPDRFSGSGSGTDFTLKISRVEAEDVGVYYCMQALQTPRTFGQGTKVEIK

SEQ ID NO: 4655 - protein, 112 aa, Artificial Sequence
  Description of Artificial Sequence: Synthetic light chain variable domain
DIVMTQTPLSSPVTLGQPASISCRSSQSLIHTDGNIYLSWLQQRPGQPPRLLIYKISNRFSGVPDRFSGSGAGTDFTLKISRVEAEDVGVYYCMQGTQFPITFGQGTRLEIK

SEQ ID NO: 4656 - protein, 112 aa, Artificial Sequence
  Description of Artificial Sequence: Synthetic light chain variable domain
DIVMTQTPLSSPVTLGQPASISCRSSQSLVHRDGNTYLSWLQQRPGQPPRLLIYKISNRFSGVPDRFSGSGAGTDFTLKISRVEAEDVGIYFCMHTTQFPWTFGQGTRVEIK

SEQ ID NO: 4657 - protein, 113 aa, Artificial Sequence
  Description of Artificial Sequence: Synthetic light chain variable domain
DIVMTQTPLSSPVTLGQPASISCRSSQSLVHSDGNTYLSWLHQRPGQPPRLLIYKISNRFSGVPDRFSGSGAGTAFTLKISRVEAEDVGVYYCMQATQLPRTFGQGTKVEIKR

SEQ ID NO: 4658 - protein, 165 aa, Artificial Sequence
  Description of Artificial Sequence: Synthetic light chain variable domain
DIVMTQTPLSSPVTLGQPASISCRSSQSLVHSDGNTYLSWLHQRPGQPPRLLIYKISNRFSGVPDRFSGSGAGTAFTLKISRVEAEDVGVYYCMQATQLPRTFGQGTKVEIKRTVAAPSVFIFPPSDEQLKSGTASVVCLLNNFYPREAKVQWKVDNALQSGNSQ

SEQ ID NO: 4659 - protein, 113 aa, Artificial Sequence
  Description of Artificial Sequence: Synthetic light chain variable domain
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPRTFGQGTKVEIKR

SEQ ID NO: 4660 - protein, 112 aa, Artificial Sequence
  Description of Artificial Sequence: Synthetic light chain variable domain
DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIK

SEQ ID NO: 4661 - protein, 108 aa, Artificial Sequence
  Description of Artificial Sequence: Synthetic light chain variable domain
DIELTQSPASLSVATGEKVTIRCMTSTDIDDDMNWYQQKPGEPPKFLISEGNTLRPGVPSRFSSSGTGTDFVFTIENTLSEDVGDYYCLQSFNVPLTFGDGTKLEKAL

SEQ ID NO: 4662 - protein, 214 aa, Artificial Sequence
  Description of Artificial Sequence: Synthetic light chain variable domain
DIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4663 - protein, 107 aa, Artificial Sequence; identical to SEQ ID NO: 4645
  Description of Artificial Sequence: Synthetic light chain variable domain

SEQ ID NO: 4664 - protein, 107 aa, Artificial Sequence
  Description of Artificial Sequence: Synthetic light chain variable domain
DIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIK

SEQ ID NO: 4665 - protein, 106 aa, Artificial Sequence
  Description of Artificial Sequence: Synthetic light chain variable domain
DIQMTQSPSSLSASVGDRVTISCRASSSVSYMHWYQQKPGKAPKPWAYATSNLASGVPSRFSGSGSGTDYTLTFSSLQPEDFATYYCQQWSSNPLTFGGGTKVEIK

SEQ ID NO: 4666 - protein, 119 aa, Artificial Sequence
  Description of Artificial Sequence: Synthetic light chain variable domain
EVQLVESGGGLVKPGGSLRLSCAASGFTFSDAWMDWVRQAPGTYKGLEWVAEIRSKASNHAYYAESVKGRFTISRDDSKNTLYLQMNSLKTEDTAVYYCTRWRRFFDSWGQGTLVTVSS

SEQ ID NO: 4667 - protein, 118 aa, Artificial Sequence; identical to SEQ ID NO: 2158
  Description of Artificial Sequence: Synthetic light chain variable domain

SEQ ID NO: 4668 - protein, 118 aa, Artificial Sequence
  Description of Artificial Sequence: Synthetic light chain variable domain
EVQLVESQGGLVKPGGSLRLSCAASGFTFSDAWMDWVRQAPGKGLEWVGEIRSQASNHATYYAESVKGRFTISRDDSKNTLYLQMNSLKTEDTAVYYCTRWRRFFDSWGQGTLVTVSS

SEQ ID NO: 4669 - protein, 118 aa, Artificial Sequence; identical to SEQ ID NO: 2160
  Description of Artificial Sequence: Synthetic light chain variable domain

SEQ ID NO: 4670 - protein, 120 aa, Artificial Sequence
  Description of Artificial Sequence: Synthetic light chain variable domain
EVQLVESGGGLVKPGGSLRLSCAASGFTFSDAWMDWVRQAPGKGLEWVSEIRSKASNHATYYAESVKGRFTFSRDDSKNTLYLQMNSLKTEDTAVYYCTRWRRPLEFDSWGQGTLVTVSS

SEQ ID NO: 4671 - protein, 106 aa, Artificial Sequence
  Description of Artificial Sequence: Synthetic light chain variable domain
DIQMTQSPSSLSASVGDRATITCRASSSVSYMHWYQQKPGKAPKPWAYATSNLASGVPSRFSGSGSGTDYTLTISSLQPEDFATYYCQQWSSNPLTFGGGTKVEIK

SEQ ID NO: 4672 - protein, 106 aa, Artificial Sequence
  Description of Artificial Sequence: Synthetic light chain variable domain
DIQLTQSPSSLSASVGDRATITCRASSSVSYMHWYQQKPGKAPKPWAYATSNLASGVPSRFSGSGSGTDYWLTISSLQPEDFATYYCQQWSSNPLTFGGGTKVEIK

SEQ ID NO: 4673 - protein, 106 aa, Artificial Sequence
  Description of Artificial Sequence: Synthetic light chain variable domain
DIQLTQSPSSLSASVGDRATITCRASSSVSYMHWYQQKPGKAPKPWIYASSNLASGVPSRFSGSGSGTDYTLTISSLQPEDFATYYCQQWSSNPLTFGGGTKVEIK

SEQ ID NO: 4674 - protein, 106 aa, Artificial Sequence
  Description of Artificial Sequence: Synthetic light chain variable domain
DIQLTQSPSSLSASVGDRVTISCRASSSVSYMHWYQQKPGKAPKPWAYATSNLASGVPSRFSGSGSGTDYTLTISSLQPEDFATYYCQQWSSNPLTFGGGTKVEIK

SEQ ID NO: 4675 - protein, 180 aa, Artificial Sequence
  Description of Artificial Sequence: Synthetic light chain variable domain
DIQLTQSPSSLSASVGDRVTISCRASSSVSYMHWYQQKPGKAPKPWIYASSNLASGVPSRFSGSGSGTDYTLTISSLQPEDFATYYCQQWSSNPLTFGGGTKVEIKHWYQQKPGKAPKPWIYASSNLASGVPSRFSGSGSGTDYTLTISSLQPEDFATYYCQQWSSNPLTFGGGTKVQIL

SEQ ID NO: 4676 - protein, 106 aa, Artificial Sequence
  Description of Artificial Sequence: Synthetic light chain variable domain
DIQMTQSPSSLSASVGDRATITCRASSSVSYMHWYQQKPGKAPKPWIYASSNLASGVPSRFSGSGSGTDYWLTISSLQPEDFATYYCQQWSSNPLTFGGGTKVEIK

SEQ ID NO: 4677 - protein, 106 aa, Artificial Sequence
  Description of Artificial Sequence: Synthetic light chain variable domain
DIQMTQSPSSLSASVGDRVTISCRASSSVSYMHWYQQKPGKAPKPWIYASSNLASGVPSRFSGSGSGTDYTLTISSLQPEDFATYYCQQWSSNPLTFGGGTKVEIK

SEQ ID NO: 4678 - protein, 106 aa, Artificial Sequence; identical to SEQ ID NO: 4677
  Description of Artificial Sequence: Synthetic light chain variable domain

SEQ ID NO: 4679 - protein, 106 aa, Artificial Sequence; identical to SEQ ID NO: 3296
  Description of Artificial Sequence: Synthetic light chain variable domain

SEQ ID NO: 4680 - protein, 106 aa, Artificial Sequence; identical to SEQ ID NO: 3297
  Description of Artificial Sequence: Synthetic light chain variable domain

SEQ ID NO: 4681 - protein, 106 aa, Artificial Sequence
  Description of Artificial Sequence: Synthetic light chain variable domain
DIQMTQSPSSLSASVGDRVTITCRASSSVSYMHWYQQKPGKAPKLLIYATSNLASGVPSRFSGSGSGTDFTLTISSLQPEDFATYYCQQWSSNPLTFGGGTKVEIK

SEQ ID NO: 4682 - protein, 106 aa, Artificial Sequence
  Description of Artificial Sequence: Synthetic light chain variable domain
DIQMTQSPSSLSASVGDRVTITCRASSSVSYMHWYQQKPGKAPKPWIYATSNLASGVPSRFSGSGSGTDYTLTISSLQPEDFATYYCQQWSSNPLTFGGGTKVEIK

SEQ ID NO: 4683 - protein, 106 aa, Artificial Sequence
  Description of Artificial Sequence: Synthetic light chain variable domain
DIQLTQSPSSLSASVGDRVTITCRASSSVSYMHWYQQKPGKAPKPWIYATSNLASGVPSRFSGSGSGTDYTLTISSLQPEDFATYYCQQWSSNPLTFGGGTKVEIK

SEQ ID NO: 4684 - protein, 106 aa, Artificial Sequence
  Description of Artificial Sequence: Synthetic light chain variable domain
EIVLTQSPATLSLSPGERATLSCRASSSVSYMHWYQQKPGQAPRLLIYATSNLASGIPARFSGSGSGTDFTLTISSLEPEDFAVYYCQQWSSNPLTFGGGTKVEIK

SEQ ID NO: 4685 - protein, 106 aa, Artificial Sequence
  Description of Artificial Sequence: Synthetic light chain variable domain
EIVLTQSPATLSLSPGERATLSCRASSSVSYMHWYQQKPGQAPRPWIYATSNLASGVPARFSGSGSGTDYTLTISSLEPEDFAVYYCQQWSSNPLTFGGGTKVEIK

SEQ ID NO: 4686 - protein, 118 aa, Artificial Sequence
  Description of Artificial Sequence: Synthetic light chain variable domain
EVQLVESGGGLVQPGGSLKLSCAASGFTFSDAWMDWVRQASGKGLEWVGEIRSKASNHATYYAESVKGRFTISRDDSKNTAYLQMNSLKTEDTAVYYCTRWRRFFDSWGQGTLVTVSS

SEQ ID NO: 4687 - protein, 106 aa, Artificial Sequence; identical to SEQ ID NO: 4671
  Description of Artificial Sequence: Synthetic light chain variable domain

SEQ ID NO: 4688 - protein, 106 aa, Artificial Sequence; identical to SEQ ID NO: 3294
  Description of Artificial Sequence: Synthetic light chain variable domain

SEQ ID NO: 4689 - protein, 106 aa, Artificial Sequence; identical to SEQ ID NO: 4673
  Description of Artificial Sequence: Synthetic light chain variable domain

SEQ ID NO: 4690 - protein, 106 aa, Artificial Sequence; identical to SEQ ID NO: 4674
  Description of Artificial Sequence: Synthetic light chain variable domain

SEQ ID NO: 4691 - protein, 106 aa, Artificial Sequence; identical to SEQ ID NO: 3295
  Description of Artificial Sequence: Synthetic light chain variable domain

SEQ ID NO: 4692 - protein, 111 aa, Artificial Sequence
  Description of Artificial Sequence: Synthetic light chain variable domain
QIVLTQSPAIMSASLGERVTMTCTVSSSVNSSYLHWYQQKPGSSPKLWIYSTSNLPSGVPARFSGSGSGTSYSLTISTIESEDAATYYCHQYHRSPQFTFGSGTKLEIKRA

SEQ ID NO: 4693 - protein, 112 aa, Artificial Sequence
  Description of Artificial Sequence: Synthetic light chain variable domain
DIVLTQSPASLAVSLGQRATISCRASESVDTFGYSFIYWYQQKPGQPPRLLIYRASNLESGIPARFSGSGSRTDFTLTINPVEADDVATYYCQQSNEDPPTFGGGTKLEIKR

SEQ ID NO: 4694 - protein, 113 aa, Artificial Sequence
  Description of Artificial Sequence: Synthetic light chain variable domain
DVVMSQIPLTLSVTIGQPASISCKSSQSLIHSDGKTYLNWLLQRPGQSPKRLIYLVSRLDSGVPDRFTGSGSGTDFTLKISRVEAEDLGVYYCWQGSHFPRTFGGGTKLEIKR

SEQ ID NO: 4695 - protein, 110 aa, Artificial Sequence
  Description of Artificial Sequence: Synthetic light chain variable domain
EIVLTQSPATMSASPGERVTMTCTVSSSVNSSYLHWYQQKPGSSPKLWIYSTSNLPSGVPARFSGSGSGTSYSLTISTIESEDAATYYCHQYHRSPQFTFGGGTKLEIKR

SEQ ID NO: 4696 - protein, 112 aa, Artificial Sequence
  Description of Artificial Sequence: Synthetic light chain variable domain
DIVLTQSPDSLAVSLGERATISCRASESVDTFGYSFIYWYQQKPGQPPRLLIYRASNLESGIPDRFSGSGSRTDFTLTINPVEAEDVATYYCQQSNEDPPTFGGGTKLEIKR

SEQ ID NO: 4697 - protein, 112 aa, Artificial Sequence
  Description of Artificial Sequence: Synthetic light chain variable domain
DIVLTQSPDSLAVSLGERATISCRASESVDTFGYSFIYWYQQKPGQPPRLLIYRASNLESGIPARFSGSGSRTDFTLTINPVEAEDVATYYCQQSNEDPPTFGGGTKLEIKR

SEQ ID NO: 4698 - protein, 112 aa, Artificial Sequence
  Description of Artificial Sequence: Synthetic light chain variable domain
DIVLTQSPDSLAVSLGERATISCRASESVDTFGYSFIYWYQQKPGQPPRLLIYRASNLESGIPDRFSGSGSRTDFTLTINPVEADDVATYYCQQSNEDPPTFGGGTKLEIKR

SEQ ID NO: 4699 - protein, 113 aa, Artificial Sequence
  Description of Artificial Sequence: Synthetic light chain variable domain
DVVMTQTPLSLSVTLGQPASISCKSSQSLIHSDGKTYLNWLLQRPGQSPKRLIYLVSRLDSGVPDRFTGSGAGTDFTLKISRVEAEDLGVYYCWQGSHFPRTFGGGTKLEIKR

SEQ ID NO: 4700 - protein, 112 aa, Artificial Sequence
  Description of Artificial Sequence: Synthetic light chain variable domain
DIVLTQSPGSLAVSLGQRATISCRASESVDTYGNSFMHWYQQKAGQPPRLLIYRASNLESGIPARFSGSGSRTDFTLTINPVEADDVATYYCQQSNEDPLTFGAGTKLELKR

SEQ ID NO: 4701 - protein, 107 aa, Artificial Sequence
  Description of Artificial Sequence: Synthetic light chain variable domain
QIVLTQSPALMSASPGEKVTMTCSASSSVSYMYWYQQKPRSSPKPWIYITSNLASGVPARFSGSGSGTSYSLTISSMEAEDAATYYCQQWSSNPPTFGGGTKLEIKR

SEQ ID NO: 4702 - protein, 107 aa, Artificial Sequence
  Description of Artificial Sequence: Synthetic light chain variable domain
DTVMTQSHKIMSTSVGDRVSITCKASQDVSIGVAWYQQRPGQSPKLLIYSASYRYTGVPDRFTGSGSGTDFTFTISSVQAEDLAVYYCQQYYIYPYTFGGGTKLEIK

SEQ ID NO: 4703 - protein, 107 aa, Artificial Sequence
  Description of Artificial Sequence: Synthetic light chain variable domain
DIQMTQSPSSLSASVGDRVTITCRASQGISNHLAWFQQKPGKAPKSLIYGASSLQTGVPSKFSGSGSGTDFTLTISSLQPEDFASYFCQQYKGYPITFGQGTRLEIK

SEQ ID NO: 4704 - protein, 113 aa, Artificial Sequence
  Description of Artificial Sequence: Synthetic light chain variable domain
DIVMTQSPDSLAVSLGERATITCKSSQSVFFRSNNKNCLTWYQQRPGQPPNLLIYWASTRESGVPDRFSGSGSGTDFTLTINNLQAEDVAVYYCQQYFGSPFTFGPGTKVDIK

SEQ ID NO: 4705 - protein, 113 aa, Artificial Sequence
  Description of Artificial Sequence: Synthetic light chain variable domain
DIVMTQSPDSLAVSLGERATITCKSSQSVFFRSNNKNCLAWYQQRPGQPPNLLIYWASTRESGVPDRFSGSGCGTDFTLTISSLQAEDVAVYYCQQYFGSPFTFGPGTKVDIK

SEQ ID NO: 4706 - protein, 113 aa, Artificial Sequence
  Description of Artificial Sequence: Synthetic light chain variable domain
DIVMTQSPDSLAVSLGERATITCKSSQSVFFRSNNKNCLAWYQQRPGQPPNLLFYWASTRESGVPDRFSGSGSGTDFTLTISSLQAEDVAVYYCQQYFGSPFTLGPGTKVDIK

SEQ ID NO: 4707 - protein, 113 aa, Artificial Sequence
  Description of Artificial Sequence: Synthetic light chain variable domain
DIVMTQSPGSLVVSLGERATITCKSSQSVFFRSNNKNCLAWYQQRPGQSPNLLIYWASTRESGVPDRFSGSGSGTDFTLTISSLQAEDVAVYYCQQYFGSPFTFGPGTKVDIK

SEQ ID NO: 4708 - protein, 113 aa, Artificial Sequence
  Description of Artificial Sequence: Synthetic light chain variable domain
DIVMTQSPDSLAVSLGERATITCKSSQSVFFRSNNKNCLAWYQQRPGQPPNLLIYWASSRESGVPDRFSGSGSGTDFALTISSLQTEDVAVYYCQQYFGSPFTFGPGTKVDIK

SEQ ID NO: 4709 - protein, 112 aa, Artificial Sequence
  Description of Artificial Sequence: Synthetic light chain variable domain
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWPLTFGGGTKVEIK

SEQ ID NO: 4710 - protein, 107 aa, Artificial Sequence
  Description of Artificial Sequence: Synthetic light chain variable domain
DIQMTQSPSSLSASVGDRVTITCRASQGISNYLAWFQQKPGKAPKSLIYAASSLQSGVPSRFSGSGSGTDFTLTISSLQPEDFATYYCQQYNSYPITFGQGTRLEIK

SEQ ID NO: 4711 - protein, 113 aa, Artificial Sequence
  Description of Artificial Sequence: Synthetic light chain variable domain
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGPGTKVDIK

SEQ ID NO: 4712 - protein, 112 aa, Artificial Sequence
  Description of Artificial Sequence: Synthetic light chain variable domain
  MOD_RES (100)..(101): Any amino acid
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWXXTFGGGTKVEIK

SEQ ID NO: 4713 - protein, 113 aa, Artificial Sequence
  Description of Artificial Sequence: Synthetic light chain variable domain
DIVMTQSPDSLAVSLGERATITCKSSQSVFFRSNNKNCLAWYQQRPGQPPNLLIYWASTRESGVPDRFSGSGSGTDFTLTISSLQAEDVAVYYCQQYFGSPFTFGPGTKVDIK

SEQ ID NO: 4714 - protein, 107 aa, Artificial Sequence
  Description of Artificial Sequence: Synthetic light chain variable domain
  MOD_RES (30)..(30): Any amino acid
  MOD_RES (53)..(53): Any amino acid
  MOD_RES (92)..(92): Any amino acid
DIQMTQSPSSLSASVGDRVTITCRASQDVXTAVAWYQQKPGKAPKLLIYSASXLYSGVPSRFSGSRSGTDFTLTISSLQPEDFATYYCQQHXTTPPTFGQGTKVEIK

SEQ ID NO: 4715 - protein, 107 aa, Artificial Sequence
  Description of Artificial Sequence: Synthetic light chain variable domain
DIQVTQSPSSLSASVGDRVTITCITSTDIESDMNWYQQKPGKVPKLLISGGNTLRPGVPSRFSGSGSGTDFTLTISSLQPEDVATYYCLQSDSLPYTFGQGTKVEIK

SEQ ID NO: 4716 - protein, 107 aa, Artificial Sequence
  Description of Artificial Sequence: Synthetic light chain variable domain
DIQVTQSPSSLSASVGDRVTITCITSTDIESDMNWYQQKPGKVPKLLISGGNTLRPGVPSRFSGSGSGTDFTLTISSLQPEDVATYYCLQSESLPYTFGQGTKVEIK

SEQ ID NO: 4717 - protein, 107 aa, Artificial Sequence
  Description of Artificial Sequence: Synthetic light chain variable domain
DIQVTQSPSSLSASVGDRVTITCITSTSIESDMNWYQQKPGKVPKLLISGGNTLRPGVPSRFSGSGSGTDFTLTISSLQPEDVATYYCLQSDSLPYTFGQGTKVEIK

SEQ ID NO: 4718 - protein, 214 aa, Artificial Sequence
  Description of Artificial Sequence: Synthetic light chain variable domain
DIQVTQSPSSLSASVGDRVTITCITSTSIESDMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4719 - protein, 107 aa, Artificial Sequence [sequence omitted]

SEQ ID NO: 4720 - protein, 454 aa, Artificial Sequence
  Description of Artificial Sequence: Synthetic light chain variable domain
EVQLQQSGAELVRPGASVKLSCTASGFNIKDDYMHWVKQRPEQGLEWIGWIDPENGDTEYASKFQGKATITSDTSSNTAYLQLSSLTSEDTAVYYCTENYYGSSFFAYWGQGTLVTVSAAKTTAPSVYPLAPVCGGTTGSSVTLGCLVKGYFPEPVTLTWNSGSLSSGVHTFPALLQSGLYTLSSSVTVTSNTWPSQTITCNVAHPASSTKVDKKIEPRVPITQNPCPPLKECPPCAAPDLLGGPSVFIFPPKIKDVLMISLSPMVTCVVVDVSEDDPDVQISWFVNNVEVHTAQTQTHREDYNSTLRVVSALPIQHQDWMSGKEFKCKVNNRALPSPIEKTISKPRGPVRAPQVYVLPPPAEEMTKKEFSLTCMITGFLPAEIAVDWTSNGRTEQNYKNTATVLDSDGSYFMYSKLRVQKSTWERGSLFACSVVHEGLHNHLTTKTISRSLGK

SEQ ID NO: 4721 - protein, 238 aa, Artificial Sequence
  Description of Artificial Sequence: Synthetic light chain variable domain
METDTLLLWVLLLWVPGSTGDIQMTQSPSSLSASVGDRVTITCRASKSVSTSAYSYMHWYQQKPGKAPKLLIYLASNLESGVPSRFSGSGSGTDFTLTISSLQPEDFATYYCQHSRELPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4722 - protein, 112 aa, Artificial Sequence
  Description of Artificial Sequence: Synthetic light chain variable domain
DIQMTQSPSSLSASVGDRVTITCRASKSVSTSAYSYMHWYQQKPGKAPKLLIYLASNLESGVPSRFSGSGSGTDFTLTISSLQPEDFATYYCQHSRELPYTFGQGTKLEIKR

SEQ ID NO: 4723 - protein, 113 aa, Artificial Sequence
  Description of Artificial Sequence: Synthetic light chain variable domain
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIK

SEQ ID NO: 4724 - protein, 107 aa, Artificial Sequence
  Description of Artificial Sequence: Synthetic light chain variable domain
QIVLTQSPAIMSASPGEKVTMTCSASSGVNFMHWYQQKSGTSPKRWIFDTSKLASGVPARFSGSGSGTSYSLTISSMEAEDAATYYCQQWSFNPPTFGGGTKLEIKR

SEQ ID NO: 4725 - protein, 112 aa, Artificial Sequence
  Description of Artificial Sequence: Synthetic light chain variable domain
DVLMTQTPLWLPVSLGDQASISCRSSQSIVHSNGNTYLEWYLQKPGQSPKLLIYKVSNRFSGVPDRFSGSGSGTDFTVKISRVEAEDLGVYYCFGGSHVPYTFGGGTKLEIK

SEQ ID NO: 4726 - protein, 108 aa, Artificial Sequence
  Description of Artificial Sequence: Synthetic light chain variable domain
QSVLTQPPSVSVSPGQTASISCSGNKLGTKYVYWYQKRPGQSPVLVMYEDNQRPSGIPERFSGSNSGNTATLTIRGTQTVDEADYYCQAWDSDTFVVFGGGTKVTVLG

SEQ ID NO: 4727 - protein, 110 aa, Artificial Sequence
  Description of Artificial Sequence: Synthetic light chain variable domain
SYVLTQPPSVSVAPGKTARITCGGNNIGSKSVHWYQQKPGQAPVVVIHYDSDRPSGIPERFSGSNSGNTATLTISRVEAGDEADYYCQVWDSSSDHPYVFGTGTKVTVLG

SEQ ID NO: 4728 - protein, 109 aa, Artificial Sequence
  Description of Artificial Sequence: Synthetic light chain variable domain
SYVLTQPLSVSVAPGKTARITCGGNNIGSKTVHWYQQKPGQAPVLVIYYDSDRPSGIPERFSGSNSGNTATLTISRVEAGDEADYYCQVWDSSSDHRVFGGGTKLTVLG

SEQ ID NO: 4729 - protein, 110 aa, Artificial Sequence
  Description of Artificial Sequence: Synthetic light chain variable domain
QSALTQPASVSGSPGQSMSCTGTSSDVGGYNYVSWYQQHPGKAPKLMIYDVSNRPSGVSNRFSGSKSGNTASLTISGLQAEDEADYYCSSYTSSSTSKVFGGGTKLTVLG

SEQ ID NO: 4730 - protein, 111 aa, Artificial Sequence
  Description of Artificial Sequence: Synthetic light chain variable domain
QSVLTQPPSASGTPGQTVTISCSGSNSNIGSNYVYWYQQLPGTAPKLLIYRNNQRPSGVPDRFSGSKSGTSASLAISGLRSEDEADYYCAAWDDSLSAYVFGTGTKVTVLG

SEQ ID NO: 4731 - protein, 111 aa, Artificial Sequence
  Description of Artificial Sequence: Synthetic light chain variable domain
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLG

SEQ ID NO: 4732 - protein, 110 aa, Artificial Sequence
  Description of Artificial Sequence: Synthetic light chain variable domain
QSALTQPASVSGSPGQSMSCTGTSSDVGGYNSVSWYQQHPGKAPRLMIYDVSNRPSGVSNRFSGSKSGNTASLTISGLQAEDEADYYCSSYTSSSTPLVFGTGTKVTVLG

SEQ ID NO: 4733 - protein, 111 aa, Artificial Sequence
  Description of Artificial Sequence: Synthetic light chain variable domain
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLG

SEQ ID NO: 4734 - protein, 111 aa, Artificial Sequence
  Description of Artificial Sequence: Synthetic light chain variable domain
QSVLTQPPSVSAAAGQKVTISCSGSDSNIGNNYVSWYQHLPGTAPKLLIYDVKNRPSGIPDRFSGSKSGSSATLGIAGLQPGDEADYYCGTWDSRLDAYVFGTGTKVTVLG

SEQ ID NO: 4735 - protein, 112 aa, Artificial Sequence
  Description of Artificial Sequence: Synthetic light chain variable domain
QSVVTQPPSVSGAPGQRVTISCTGSTSNIGAGYDVHWYQQLPGTAPKLLIYTNNFRPSGVPDRFSASKSGTSASLAITGLQAEDEADYYCGTWDSSLSAVVFGGGTKLTVLG

SEQ ID NO: 4736 - protein, 109 aa, Artificial Sequence
  Description of Artificial Sequence: Synthetic light chain variable domain
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKVTVLG

SEQ ID NO: 4737 - protein, 112 aa, Artificial Sequence
  Description of Artificial Sequence: Synthetic light chain variable domain
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSVVFGGGTKLTVLG

SEQ ID NO: 4738 - protein, 107 aa, Artificial Sequence
  Description of Artificial Sequence: Synthetic light chain variable domain
DIELTQSPAIMSVSPGEKVTMTCRASSSVSSSYLHWYQQRSGASPKIWIYSTSNLASGVPARFSGSGTGTSYSLTISSVEAEDAATYYCQQYSGYPWTFGGGTKLEI

SEQ ID NO: 4739 - protein, 106 aa, Artificial Sequence
  Description of Artificial Sequence: Synthetic light chain variable domain
DIELTQSPKFMSTSVGDRVSVTCKASQNVGTNVAWYQQKPGQSPKPLIYSATYRNSGVPDRFTGSGSGTDFTLTITNVQSKDLADYFCQQYNRYPYTSGGGTKLEI

SEQ ID NO: 4740 - protein, 108 aa, Artificial Sequence
  Description of Artificial Sequence: Synthetic light chain variable domain
DIQMTQSPSSLSASVGDRVTITCRASQDVDTSLAWYQQKPGKAPKLLIYSASFLYSGVPSRFSGSGSGTDFTLTISSLQPEDFATYYCQQSTGHPQTFGQGTKVEIKR

SEQ ID NO: 4741 - protein, 108 aa, Artificial Sequence
  Description of Artificial Sequence: Synthetic light chain variable domain
DIQMTQSPSSLSASVGDRVTITCRASQDVDISLAWYQQKPGKAPKLLIYSASFLYSGVPSRFSGSGSGTDFTLTISSLQPEDFATYYCQQGAGNPYTFGQGTKVEIKR

SEQ ID NO: 4742 - protein, 108 aa, Artificial Sequence
  Description of Artificial Sequence: Synthetic light chain variable domain
DIQMTQSPSSLSASVGDRVTITCRASQDVSTAVAWYQQKPGKAPKLLIYSASFLYSGVPSRFSGSGSGTDFTLTISSLQPEDFATYYCQQTYTTSLTFGQGTKVEIKR

SEQ ID NO: 4743 - protein, 108 aa, Artificial Sequence
  Description of Artificial Sequence: Synthetic light chain variable domain
DIQMTQSPSSLSASVGDRVTITCRASQDVETSLAWYQQKPGKAPKLLIYSASFLYSGVPSRFSGSGSGTDFTLTISSLQPEDFATYYCQQSTGHPQTFGQGTKVEIKR

SEQ ID NO: 4744 - protein, 108 aa, Artificial Sequence
  Description of Artificial Sequence: Synthetic light chain variable domain
DIELTQPPSVSVAPGQTARISCSGDKLGKKYASWYQQKPGQAPVLVIYEKDNRPSGIPERFSGSNSGNTATLTISGTQAEDEADYYCSSFAGNSLEVFGGGTKLTVLG

SEQ ID NO: 4745 - protein, 108 aa, Artificial Sequence
  Description of Artificial Sequence: Synthetic light chain variable domain
DIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLG

SEQ ID NO: 4746 - protein, 114 aa, Artificial Sequence
  Description of Artificial Sequence: Synthetic light chain variable domain
DIVMTQSPDSLAVSLGERATINCKSSQSVLYNSNNKKYLAWYQQKPGQPPKLLIYWASTRESGVPDRFSGSGSGTDFTLTISSLQAEDVAVYYCQQYYSTPWTFGQGTKVEIKR

SEQ ID NO: 4747 - protein, 108 aa, Artificial Sequence
  Description of Artificial Sequence: Synthetic light chain variable domain
DIDILMTQSPATLSVTPGDRVSLSCRASQSIRDYLHWYQHRSHESPRLLIKYASQSISGIPSRFSGSGSGSDFTLTINSVEPEDVGVYYCQNGHSFPTFGGGTKLEIK

SEQ ID NO: 4748 - protein, 109 aa, Artificial Sequence
  Description of Artificial Sequence: Synthetic light chain variable domain
DIDILMTQSPSSMYASLGERVTITCKASHDIKSYLSWYQQKPWRSPKTLIYYTTALADGVPSRFSGSGSGQDYSLTISSLESDDTATYYCLQHGESPYTFGGGTKLEIK

SEQ ID NO: 4749 - protein, 211 aa, Artificial Sequence
  Description of Artificial Sequence: Synthetic light chain variable domain
SIVMTQTPAFLLVSAGERVTITCRASQSVSNDVTWYQQKAGQAPRLLIYSASNRYTGIPARFSGSGYGTEFTFTISSVQSEDFAVYFCQQDYSSFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4750 - protein, 108 aa, Artificial Sequence
  Description of Artificial Sequence: Synthetic light chain variable domain
ENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVK

SEQ ID NO: 4751 - protein, 108 aa, Artificial Sequence
  Description of Artificial Sequence: Synthetic light chain variable domain
ENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIK

SEQ ID NO: 4752 - protein, 104 aa, Artificial Sequence
  Description of Artificial Sequence: Synthetic light chain variable domain
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIK

SEQ ID NO: 4753 - protein, 211 aa, Artificial Sequence
  Description of Artificial Sequence: Synthetic light chain variable domain
SIVMTQTPKFLLVSAGDRVTITCKASQSVSNDVTWYQQKAGQSPKLLIYSASNRYSGVPDRFTGSGYGTAFTFTISTVQAEDLAVYFCQQDYSSFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4754 - protein, 211 aa, Artificial Sequence
  Description of Artificial Sequence: Synthetic light chain variable domain
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4755 - protein, 211 aa, Artificial Sequence
  Description of Artificial Sequence: Synthetic light chain variable domain
SIVMTQTPKTLSVSAGERVTITCKASQSVSNDVTWYQQKPGQSPKLLIYSASNRYSGVPDRFSGSGYGTAFTFTISSVQAEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4756 - protein, 449 aa, Artificial Sequence
  Description of Artificial Sequence: Synthetic light chain variable domain
QVQLVESGPGLVQPGRSLRLTCAVSGFSVTNYGVHWVRQPPGKGLEWLGVIWAGGITNYNSAFMSRLTISKDNSKNTVYLQMNSLRAEDTAVYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4757 - protein, 107 aa, Artificial Sequence
  Description of Artificial Sequence: Synthetic light chain variable domain
DIQMTQITSSLSVSLGDRVIISCRASQDIGNFLNWYQQKPDGSLKLLIYYTSRLQSGVPSRFSGWGSGTDYSLTISNLEEEDIATFFCQQGKTLPYTFGGGTKLEIK

SEQ ID NO: 4758 - protein, 108 aa, Artificial Sequence
  Description of Artificial Sequence: Synthetic light chain variable domain
DIVLTQSPATLSVTPGDSVSLSCRASQIISNNLHWYQQKSHESPRLLIKYASQSISGIPSRFSGSGSGTDFTLSINSVETEDFGMYFCQQSNSWPLTFGSGTKLEIKR

SEQ ID NO: 4759 - protein, 107 aa, Artificial Sequence
  Description of Artificial Sequence: Synthetic light chain variable domain
DIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIK

SEQ ID NO: 4760 - protein, 106 aa, Artificial Sequence
  Description of Artificial Sequence: Synthetic light chain variable domain
DIQLTQSPAILSVSPGERVSFSCWASQSIGTSIHWYQQRTNGSPRLLIKYSSESISGIPSRFSGSGSGTDFTLSINSLESEDIADYYCQQTYSWPFTFGSGTKLEI

SEQ ID NO: 4761 - protein, 112 aa, Artificial Sequence
  Description of Artificial Sequence: Synthetic light chain variable domain
DIVMTQSPLSLPVTPGEPASISCRSSQSIVHSNGNTYLEWYLQKPGQSPQLLISKVSNRFSGVPDRFSGSGSGTDFTLKISRVEAEDVGVYYCFQGSHVPFTFGQGTKLEIK

SEQ ID NO: 4762 - protein, 107 aa, Artificial Sequence
  Description of Artificial Sequence: Synthetic light chain variable domain
QIVLTQSPAIMSASPGEKVTITCSASSSVSYMHWFQQKPGTSPKLWIYSTSNLASGVPARFSGSGSGTSYSLTISRMEAEDAATYYCQQRSSYPYTFGGGTKLEIKR

SEQ ID NO: 4763 - protein, 108 aa, Artificial Sequence
  Description of Artificial Sequence: Synthetic light chain variable domain
DIQLTQSPSSLSASVGDRVTITCSASSSVSYMHWYQQKPGKAPKLLIYSTSNLASGVPSRFSGSGSGTDFTFTISSLQPEDIATYYCQQRSSYPYTFGGGTKVEIKRT

SEQ ID NO: 4764 - protein, 108 aa, Artificial Sequence
  Description of Artificial Sequence: Synthetic light chain variable domain
DIQMTQSPSSLSASVGDRVTITCSASSSVSYMHWYQQKPGKAPKLLIYSTSNLASGVPSRFSGSGSGTDFTLTISSLQPEDFATYYCQQRSSYPYTFGQGTKVEIKRT

SEQ ID NO: 4765 - protein, 108 aa, Artificial Sequence
  Description of Artificial Sequence: Synthetic light chain variable domain
DIQLTQSPSSLSASPGDRVTITCSASSSVSYMHWFQQKPGKAPKLWIYSTSNLASGVPARFSGSGSGTSYSLTISRLQPEDIATYYCQQRSSYPYTFGGGTKVEIKRT

SEQ ID NO: 4766 - protein, 108 aa, Artificial Sequence
  Description of Artificial Sequence: Synthetic light chain variable domain
DIQLTQSPSSLSASPGDRVTITCSASSSVSYMHWFQQKPGKAPKLWIYSTSNLASGVPSRFSGSGSGTSYSLTISRLQPEDIATYYCQQRSSYPYTFGGGTKVEIKRT

SEQ ID NO: 4767 - protein, 108 aa, Artificial Sequence
  Description of Artificial Sequence: Synthetic light chain variable domain
DIQLTQSPSSLSASPGDRVTITCSASSSVSYMHWFQQKPGKAPKLWIYSTSNLASGVPSRFSGSGSGTSYSFTISSLQPEDIATYYCQQRSSYPYTFGGGTKVEIKRT

SEQ ID NO: 4768 - protein, 108 aa, Artificial Sequence
  Description of Artificial Sequence: Synthetic light chain variable domain
DIQLTQSPSSLSASPGDRVTITCSASSSVSYMHWYQQKPGKAPKLWIYSTSNLASGVPSRFSGSGSGTSYSLTISRLQPEDIATYYCQQRSSYPYTFGGGTKVEIKRT

SEQ ID NO: 4769 - protein, 108 aa, Artificial Sequence
  Description of Artificial Sequence: Synthetic light chain variable domain
DIQLTQSPSSMSASPGDRVTITCSASSSVSYMHWFQQKPGKSPKLWIYSTSNLASGVPSRFSGSGSGTSYSLTISSMQPEDFATYYCQQRSSYPYTFGQGTKLEIKRT

SEQ ID NO: 4770 - protein, 113 aa, Artificial Sequence
  Description of Artificial Sequence: Synthetic light chain variable domain
DIVMSQSPSSLVVSIGEKVTMTCKSSQSLLYSSNQKNYLAWYQQKPGQSPKLLIYWASSRESGVPDRFTGSGSGTDFTLTISSVKAEDLAVYYCQQYYNYPLTFGAGTKLELK

SEQ ID NO: 4771 - protein, 113 aa, Artificial Sequence
  Description of Artificial Sequence: Synthetic light chain variable domain
DIVMSQSPSSLAVSVGERVTMNCKSSQSLLYSSNQKNYLAWYQQKPGQSPKLLIYWASTRESGVPDRFTGSVSGTDFTLTISSVKAEDLAVYYCQQYYNYPLTFGAGTKLELK

SEQ ID NO: 4772 - protein, 107 aa, Artificial Sequence
  Description of Artificial Sequence: Synthetic light chain variable domain
DIQMTQSPSSLSASVGDRVTITCRASQSISSYLNWYQQKPGKAPKLLIYNASMLQSGVPSRFSGSGSGTDFTLTISSLQPEDFATYYCQQNRGFPLTFGQGTKVEIK

SEQ ID NO: 4773 - protein, 113 aa, Artificial Sequence
  Description of Artificial Sequence: Synthetic light chain variable domain
DIVMSQSPSSLAVSVGEKVTVNCKSSQSLLYSNNQKNYLAWYQQKPGQSPKLLIYWASTREYGVPDRFTGSGSGTDFTLTISSVKAEDLAVYYCQQYYNYPLTFGAGTKLELK

SEQ ID NO: 4774 - protein, 113 aa, Artificial Sequence
  Description of Artificial Sequence: Synthetic light chain variable domain
DIVMSQSPSSLAVSVGEKVTMSCKSSQSLLYSNNQKNYLAWYHQKPGQSPKLLIYWASTRESGVPDRFTGSGSGTDFTLTISSVKAEDLAVYYCQQYYSYPLTFGAGTKLELK

SEQ ID NO: 4775 - protein, 113 aa, Artificial Sequence
  Description of Artificial Sequence: Synthetic light chain variable domain
DIVMSQSPSSLAVSVGEKVTMSCKSSQSLLYSNNQKNYLAWYHQKPGQSPKLLIYWASTRESGVPDRFTGSGSGTDFTLTISSVKAEDLAVYYCQQYYIYPLTFGAGTKLELK

SEQ ID NO: 4776 - protein, 113 aa, Artificial Sequence
  Description of Artificial Sequence: Synthetic light chain variable domain
DIVMSQSPSSLAVSVGEKVTMSCKSSQSLLYSNNQKNYLAWYHQKPGQSPKLLIYWASTRESGVPDRFTGSGSGTDFTLTISSVKAEDLAVYYCQQYYSYPLTFGAGTKLEIK

SEQ ID NO: 4777 - protein, 107 aa, Artificial Sequence
  Description of Artificial Sequence: Synthetic light chain variable domain
DIQMTQSPSSLSASVGDRVTITCRASQSISSYLNWYQQKPGKAPKLLIYAASMLQSGVPSRFSGSGSGTDFTLTISSLQPEDFATYYCQQNRGFPLTFGQGTKVEIK

SEQ ID NO: 4778 - protein, 108 aa, Artificial Sequence
  Description of Artificial Sequence: Synthetic light chain variable domain
DIQLTQSPSSLSASVGDRVTITCRASQSISSYLNWYQQKPGKAPKLLIYAASSLQSGVPSRFSGSGSGTDFTLTISSLQPADFATYYCQQSYSVPYTFGQGTKLEIKR

SEQ ID NO: 4779 - protein, 111 aa, Artificial Sequence
  Description of Artificial Sequence: Synthetic light chain variable domain
QSALTQPASVSGSPGQSITISCTGTSSDVGGYNFVSWYQQHPGKAPKVMIYDVSKRPSGISNRFSGSKSGNTASLTISGLQVEDEAEYYCSSYTSTRTVIFAGGTKVTVLG

SEQ ID NO: 4780 - protein, 111 aa, Artificial Sequence
  Description of Artificial Sequence: Synthetic light chain variable domain
  MOD_RES (37)..(37): Any amino acid
QSVLTQPPSLSGAPGQRVTISCSGSRSNIGTNYVSWXQQLPGTAPKLLIYRNHQWPSGVPDRFTGSKSGTSASLAISGLRSEDEADYYCAAWDDNLSGVVFGGGTKLTVLG

SEQ ID NO: 4781 - protein, 111 aa, Artificial Sequence
  Description of Artificial Sequence: Synthetic light chain variable domain
QSVLTQPPSVSAAPGQKVTIPCSGSRSNVGNYYVSWYQQLPGTAPKLLIYDNNKRPSGIPDRFSGSKSGTSATLGITGLQTGDEADYFCGTWDGSLSAHVFGTGTKVTVLG

SEQ ID NO: 4782 - protein, 111 aa, Artificial Sequence
  Description of Artificial Sequence: Synthetic light chain variable domain
QAVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKVTVLG

SEQ ID NO: 4783 - protein, 111 aa, Artificial Sequence
  Description of Artificial Sequence: Synthetic light chain variable domain
QSALTQPASVSGSPGQSITISCTGTSRDVGGYNYVSWYQQYPGKAPKLMIYEVSKRPSGVSNRFSGSKSGNTASLTISGLQAEDEADYYCSSYTSSSTLDFGTGTKVTVLG

SEQ ID NO: 4784 - protein, 111 aa, Artificial Sequence
  Description of Artificial Sequence: Synthetic light chain variable domain
SYELTQPPSASGTPGQRVTISCSGSSSNIGSNYVSWYQQLPGTAPKLLIYRNNQRPSGVPDRFSGSKSGTSASLAISGLRSEDEADYYCAAWDDSLSGVVFGGGTKLTVLG

SEQ ID NO: 4785 - protein, 136 aa, Artificial Sequence
  Description of Artificial Sequence: Synthetic light chain variable domain
MKKTAIAIAVALAGFATVAQAAELQSALTQPPSASGSPGQSVTISCTGTSRDAGGYNYFSWYQQHPGKAPKLLIYEVTKRPSGVPDRFSGSKSGKTASLTVSGLQADDEAVYYCSSYGGSNNFRVFGGGTKLTVLG

SEQ ID NO: 4786 - protein, 135 aa, Artificial Sequence
  Description of Artificial Sequence: Synthetic light chain variable domain
MKKTAIAIAVALAGFATVAQAAELSYELTQPPSASGTPGQRVSISCSGSSSNIGSNTVNWYQQFPGTAPKLLIHSNNQRPSGVPDRFSGSKSGTSASLAISGPQSEDEADYYCAAWDDSVNGYVFGTGTKVTVLG

SEQ ID NO: 4787 - protein, 134 aa, Artificial Sequence
  Description of Artificial Sequence: Synthetic light chain variable domain
MKKTAIAIAVALAGFATVAQAAELQPVLTQPPSASGTPGQRVTISCSGSSSNIGGNTVSWYQQVPGTAPRLLIFRNNQRPPGVPDRFSGSKSGTSASLAISGLRSEDEADYYCAAWDASRQGVFGGGTKLTVLG

SEQ ID NO: 4788 - protein, 135 aa, Artificial Sequence
  Description of Artificial Sequence: Synthetic light chain variable domain
MKKTAIAIAVALAGFATVAQAAELQSVLTQPPSASGTPGQRVTISCSGSSSNIGSNTVNWYQQLPGTAPKLLIYRNNQRPSGVPDRFSGSKSGTSASLAISGLRSEDEADYYCAAWDDSLSGRVFGGGTKLTVLG

SEQ ID NO: 4789 - protein, 111 aa, Artificial Sequence
  Description of Artificial Sequence: Synthetic light chain variable domain
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGWVFGGGTKLTVLG

SEQ ID NO: 4790 - protein, 136 aa, Artificial Sequence
  Description of Artificial Sequence: Synthetic light chain variable domain
MKKTAIAIAVALAGFATVAQAAELQSVLTQPPSVSGAPGQRVTISCTGSSSNIGAGYDVHWYQQLPGRAPKLLIYGNSNRPSGVPDRFSGSKSGTSASLAITGLQAEDEADYYCQSYDSSLRGYVFGTGTKVTVLG

SEQ ID NO: 4791 - protein, 135 aa, Artificial Sequence
  Description of Artificial Sequence: Synthetic light chain variable domain
MKKTAIAIAVALAGFATVAQAAELQSVVTQPPSVSAAPGQRVTISCSGGSSNIGNNYVSWFQQLPRTAPKLLIYDNNKRPSGIPDRFSGSKSGTSAALDITVLQTGDEADYYCGTWDSSLRNWVFGGGTKLTVLG

SEQ ID NO: 4792 - protein, 135 aa, Artificial Sequence
  Description of Artificial Sequence: Synthetic light chain variable domain
MKKTAIAIAVALAGFATVAQAAELQSVLTQPPSASGSPGQSLTISCTGTSSDVGGYNHVSWYQQYPGKAPKLMIYEVTKRPSGVPDRFSGSKSGNTASLTVSGLQAEDEADYYCSSYAGSAHWVFGGGTKLTVLG

SEQ ID NO: 4793 - protein, 111 aa, Artificial Sequence
  Description of Artificial Sequence: Synthetic light chain variable domain
QSALTQPASVSGSPGQSITISCTGTSSDVGGYNYVSWYQQHPGKAPKLMIYDVSKRPSGVSNRFSGSKSGNTASLTISGLQAEDEADYYCSSYTRSSTEVFGGGTKLTVLG

SEQ ID NO: 4794 - protein, 135 aa, Artificial Sequence
  Description of Artificial Sequence: Synthetic light chain variable domain
MKKTAIAIAVALAGFATVAQAAELQAVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGRVFGTGTKVTVLG

SEQ ID NO: 4795 - protein, 110 aa, Artificial Sequence
  Description of Artificial Sequence: Synthetic light chain variable domain
SYVLTQPPSASGTPGQRVTISCSGSSSNIGSNTVNWYQQLPGTAPKLLIYRNNQRPSGVPDRFSGSKSGTSASLAISGLRSEDEADYYCAAWDDSLSGLFGTGTKVTVLG

SEQ ID NO: 4796 - protein, 112 aa, Artificial Sequence
  Description of Artificial Sequence: Synthetic light chain variable domain
QSALTQPPSASGSPGQSVTISCTGTSRDAGGYNYFSWYQQHPGKAPKLLIYEVTKRPSGVPDRFSGSKSGKTASLTVSGLQADDEAVYYCSSYGGSNNFRVFGGGTKLTVLG

SEQ ID NO: 4797 - protein, 113 aa, Artificial Sequence
  Description of Artificial Sequence: Synthetic light chain variable domain
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLG

SEQ ID NO: 4798 - protein, 111 aa, Artificial Sequence
  Description of Artificial Sequence: Synthetic light chain variable domain
QSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLG

SEQ ID NO: 4799 - protein, 111 aa, Artificial Sequence
  Description of Artificial Sequence: Synthetic light chain variable domain
QSVLTQPASVSGSPGQSLTISCTGTSNDVGAYKYVSWYQQYPGKAPKLILYDVFKRPSGVSNRFSGSKSDNTASLTISGLQAEDEADYYCFSLTSSNTYVFGTGTKVTVLG

SEQ ID NO: 4800 - protein, 113 aa, Artificial Sequence
  Description of Artificial Sequence: Synthetic light chain variable domain
NFMLTQPHSVSESPGKTVSISCTRTSGAIAGAYVQWFQQRPGSAPTTVIYDDNKRPSGVPDRFSGSIDKSSNSASLTISGLKTEDEADYYCQSYDYDSSNVLFGGGTKLTVLG

SEQ ID NO: 4801 - protein, 111 aa, Artificial Sequence
  Description of Artificial Sequence: Synthetic light chain variable domain
QSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLG

SEQ ID NO: 4802 - protein, 110 aa, Artificial Sequence
  Description of Artificial Sequence: Synthetic light chain variable domain
SSELTQDPAVSVALGQTVRITCQGDSLRSYYASWYQQKPGQAPVLVIYGKNNRPSGIPDRFSGSSSGNTASLTITGAQAEDEADYYCNSRDSSGNPPVVFGGGTKLTVLG

SEQ ID NO: 4803 - protein, 111 aa, Artificial Sequence
  Description of Artificial Sequence: Synthetic light chain variable domain
QSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLG

SEQ ID NO: 4804 - protein, 111 aa, Artificial Sequence
  Description of Artificial Sequence: Synthetic light chain variable domain
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNTLVFGGGTKLTVLG

SEQ ID NO: 4805 - protein, 111 aa, Artificial Sequence
  Description of Artificial Sequence: Synthetic light chain variable domain
QSALTQPPSASGSPGQSVTISCTGTSSDIGGYNYVSWYQQHPGKAPKLMIYEVNKRPSGVPDRFSGSKSGNTASLTVSGLQAEDEADYYCASFAGRKTLVFGGGTKLTVLG

SEQ ID NO: 4806 - protein, 111 aa, Artificial Sequence
  Description of Artificial Sequence: Synthetic light chain variable domain
QSALTQPPSASGSPGQSVTISCTGTSTDIGGYNYVSWYQHHPSKAPKLMIYEVNKRPSGVPDRFSGSKSGNTASLTVSGLQAEDEADYYCASFAGRKTLVFGGGTKLTVLG

SEQ ID NO: 4807 - protein, 111 aa, Artificial Sequence
  Description of Artificial Sequence: Synthetic light chain variable domain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSGVVFGGGTKLTVLG

SEQ ID NO: 4808 - protein, 111 aa, Artificial Sequence
  Description of Artificial Sequence: Synthetic light chain variable domain
QSALTQPASVSGSPGQSITISCTGTSSDVGGYNYVSWYQQSPGKAPRLMIYGVSKRPSGVPDRFSGSKSGNTASLTVSGLQAEDEADYYCSSYAGVNNLMFGGGTKLTVLG

SEQ ID NO: 4809 - protein, 112 aa, Artificial Sequence
  Description of Artificial Sequence: Synthetic light chain variable domain
DIQMTQSPSSLSASVGDRVTITCRASQNIATDVSTAVAWIQQKPGKAPKLLIYSASFLYSGVPSRFSGSGSGTDFTLTISSLQPEDFATYYCQQSEPEPYTFGQGTKVEIKR

SEQ ID NO: 4810 - protein, 107 aa, Artificial Sequence
  Description of Artificial Sequence: Synthetic light chain variable domain
DIQMTQSPSSLSASVGDRVTITCRASQGISNWLAWYQQKPGKAPKLLIYGASSLQSGVPSRFSGSGSGTDFTLTISSLQPEDFATYYCQQYSSFPTTFGQGTKVEIK

SEQ ID NO: 4811 - protein, 214 aa, Artificial Sequence
  Description of Artificial Sequence: Synthetic light chain variable domain
DIQMTQSPSSLSASVGDRVTITCRASQDVNTAVAWYQQKPGKAPKLLIVSASFLVSGVPSRFSGSRSGTDFTLTISSLQPEDFATYVCQQHYTTPPTFGQGTKLEIKRTVAAPSVFIFPPSDEQLKSGTASVVCLLNNFYPREAKVQWKVDNALQSGNSQESVTEQDSKDSTVSLSSTLTLSKADYEKHKVVACEVTHQGLSSPVTKSFNRGEC

SEQ ID NO: 4812 - protein, 233 aa, Artificial Sequence
  Description of Artificial Sequence: Synthetic light chain variable domain
NYHLENEVARLKKLGGGGSDIQMTQSPSSLSASVGDRVTITCRASQDVNTAVAWYQQKPGKAPKLLIVSASFLVSGVPSRFSGSRSGTDFTLTISSLQPEDFATVYCQQHYTTPPTFGQGTKLEIKRTVAAPSVFIFPPSDEQLKSGTASVVCLLNNFYPREAKVQWKVDNALQSGNSQESVTEQDSKDSTVSLSSTLTLSKADYEKHKVVACEVTHQGLSSPVTKSFNRGEC

SEQ ID NO: 4813 - protein, 242 aa, Artificial Sequence
  Description of Artificial Sequence: Synthetic light chain variable domain
NYHLENEVARLKKLGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLVSLSSVVTVPSSSLGTQTVICNVNHKPSNTKVDKKVEPKSC

SEQ ID NO: 4814 - protein, 232 aa, Artificial Sequence
  Description of Artificial Sequence: Synthetic light chain variable domain
DYKDDDDKGGGGSGGGGSDIQMTQSPSSLSASVGDRVTITCRASQDVNTAVAWYQQKPGKAPKLLIVSASFLVSGVPSRFSGSRSGTDFTLTISSLQPEDFATYVCQQHYTTPPTFGQGTKLEIKRTVAAPSVFIFPPSDEQLKSGTASVVCLLNNFYPREAKVQWKVDNALQSGNSQESVTEQDSKDSTVSLSSTLTLSKADYEKHKVVACEVTHQGLSSPVTKSFNRGEC

SEQ ID NO: 4815 - protein, 246 aa, Artificial Sequence
  Description of Artificial Sequence: Synthetic light chain variable domain
DYKDDDDKGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTVICNVNHKPSNTKVDKKVEPKSCDKTHT

SEQ ID NO: 4816 - protein, 112 aa, Artificial Sequence
  Description of Artificial Sequence: Synthetic light chain variable domain
DIVMTQSPDSLAVSLGERATINCRASQSVSGSRFTYMHWYQQKPGQPPKLLIKYASILESGVPDRFSGSGSGTDFTLTISSLQAEDVAVYYCQHSWEIPPWTFGQGTKVEIK

SEQ ID NO: 4817 - protein, 219 aa, Artificial Sequence
  Description of Artificial Sequence: Synthetic light chain variable domain
DIVMTQSPDSLAVSLGERATINCRASQSVSGSRFTYMHWYQQKPGQPPKLLIKYASILESGVPDRFSGSGSGTDFTLTISSLQAEDVAVYYCQHSWEIPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4818 - protein, 219 aa, Artificial Sequence
  Description of Artificial Sequence: Synthetic light chain variable domain
DIVMTQSPDSLAVSLGERATINCRASQSVSGSRFTYMHWYQQKPGQPPKLLIKYASILESGVPDRFSGSGSGTDFTLTISSLQAEDVAVYYCQHSWEIPPWTFGQGTKVEIKRTVAAPSVFIFPPSDEQLKSGTASVVCLLNNFYPREAKVQWCVDNALQSGNSQESVTEQDSKDSTYSLSSTLTLSKADYEKHKVYACEVTHQGLSSPVTKSFNRGEC

SEQ ID NO: 4819 - protein, 214 aa, Artificial Sequence
  Description of Artificial Sequence: Synthetic light chain variable domain
DIQMTQSPSSLSASVGDRVTITCRASQDVNTAVAWYQQKPGKAPKLLIYSASFLVSGVPSRFSGSRSGTDFTLTISSLQPEDFATYYCQQHYTIPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4820 - protein, 220 aa, Artificial Sequence
  Description of Artificial Sequence: Synthetic light chain variable domain
DIVMTQSPILLAVSLGERATINCKSSQSVLNSGNQKNYLTWYQQRTNGSPRLLIYWASTRESGVPDRFSGSGSGTDFTLTISSLQAEDIADYYCQSDYSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4821 - protein, 220 aa, Artificial Sequence
  Description of Artificial Sequence: Synthetic light chain variable domain
DIVMTQSPILLAVSLGERATINCKSSQSVLNSGNQKNYLTWYQQRTNGSPRLLIYWASTRESGVPDRFSGSGSGTDFTLTISSLQAEDEADYYCQSDYSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4822 - protein, 111 aa, Artificial Sequence
  Description of Artificial Sequence: Synthetic light chain variable domain
DIVLTQSPASLAVSLGQRATISCRASKSVSTSGYSYMHWYQQKPGQPPKLLIYLVSNLESGVPARFSGSGSGTDFTLNIHPVEEEDAATYYCQHSRELPRTFGGGTKLEIK

SEQ ID NO: 4823 - protein, 112 aa, Artificial Sequence
  Description of Artificial Sequence: Synthetic light chain variable domain
DIVITQTTPSVPVTPGESVSISCRSSKSLLHSNGNTYLYWFLQRPGQSPQLLISRMSSLASGVPDRFSGSGSGTAFTLRISRVEAEDVGVYYCMQHLEYPYTFGGGTKLEIK

SEQ ID NO: 4824 - protein, 110 aa, Artificial Sequence
  Description of Artificial Sequence: Synthetic light chain variable domain
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLG

SEQ ID NO: 4825 - protein, 110 aa, Artificial Sequence
  Description of Artificial Sequence: Synthetic light chain variable domain
QAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLG

SEQ ID NO: 4826 - protein, 113 aa, Artificial Sequence
  Description of Artificial Sequence: Synthetic light chain variable domain
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPYTFGGGTKLEIK

SEQ ID NO: 4827 - protein, 111 aa, Artificial Sequence
  Description of Artificial Sequence: Synthetic light chain variable domain
DIVLTQSPASLAVSLGQRATISCKASQSVDYDGDGYMDWYQQKPGQPPKLLIFAASNLKSGIPARFSGSGSGTDFTLNIHPVEEEDAATYYCQQTNEYPWTFGGGTKLEIK

SEQ ID NO: 4828 - protein, 108 aa, Artificial Sequence
  Description of Artificial Sequence: Synthetic light chain variable domain
DVQITQSPSYLAASPGETITINCRASKSISKYLAWYQEKPGKTNKLLIYSGSTLQSGIPSRFSGSGSGTDFTLTISSLEPEDFAMYYCQQHNEYPYTFGGGTKLEIKR

SEQ ID NO: 4829 - protein, 236 aa, Artificial Sequence
  Description of Artificial Sequence: Synthetic light chain variable domain
MDMRVPAQLLGLLLLWLRGARCDIQMTQSPSSLSASVGDRVTITCRASQEISGYLSWYQQKPGKAPKRLIYAASTLDSGVPSRFSGSGSGTEFTLTISSLQPEDFATYYCLQYDSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4830 - protein, 238 aa, Artificial Sequence
  Description of Artificial Sequence: Synthetic light chain variable domain
MKLPVRLLVLMFWIPASSSDVLMTQIPLSLPVSLGDQASISCRSSQSIVHSNGNTYLEWYLQKPGQSPKSLIYKVSNRFSGVPDRFSGSGSGTDFTLKISRVEAEDLGVYYCFQGSYVPWTFGGGTKLEIKRADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 4831 - protein, 239 aa, Artificial Sequence
  Description of Artificial Sequence: Synthetic light chain variable domain
MRCLAEFLGLLVLWIPGAIGDIVLTQTAPSVPVTPGESVSISCRSSKSLLHSNGNTYLYWFLQRPGQSPQLLIYRMSNLASGVPDRFSGSGSGTAFTLRISRVEAEDVGVYYCMQHLEYPFTFGSGTKLEIKRADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 4832 - protein, 238 aa, Artificial Sequence
  Description of Artificial Sequence: Synthetic light chain variable domain
MKLPVRLLVLMFWIPASRSDVLMTQTPLSLPVSLGDQASISCRSSQSIVHSIGNTYLEWYLQKPGQSPKLLIYKVSNRFSGVPERFSGSGSGTDFTLKISRVEAEDLGVYYCFQGSHVPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 4833 - protein, 238 aa, Artificial Sequence
  Description of Artificial Sequence: Synthetic light chain variable domain
MKLPVRLLVLMFWIPASSSDVLMTQIPLSLPVSLGDQASISCRSSQSIVHSNGNTYLEWYLQKPGQSPKLLIYKVSNRFSGVPDRFSGSGSGTDFTLKISRVEAEDLGVYYCFQGSYVPWTFGGGTKLEIKRADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 4834 - protein, 234 aa, Artificial Sequence
  Description of Artificial Sequence: Synthetic light chain variable domain
MFSLALLLSLLLLCVSDSRAETTVTQSPASLSMAIGDKVTIRCITSTDIDDDMNWFQQKPGEPPKLLISEGNTLRPGVPSRFSGSGYGTDFIFTIENMLSEDVADYYCLQSDNLPYTFGGGTKLEIKRADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 4835 - protein, 238 aa, Artificial Sequence
  Description of Artificial Sequence: Synthetic light chain variable domain
MKLPVRLLVLMFWIPASSSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSYVPWTFGGGTKLEIKRADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 4836 - protein, 106 aa, Artificial Sequence
  Description of Artificial Sequence: Synthetic light chain variable domain
EIVLTQSPATLSLSPGERATLSCSASSSVSYMHWYQQKPGQAFRLLIYDTSKLASGIPARFSGSGSGTDFTLTISSLEPEDFAVYYCFQGSGYPYTFGQGTKLEIK

SEQ ID NO: 4837 - protein, 213 aa, Artificial Sequence
  Description of Artificial Sequence: Synthetic light chain variable domain
EIVLTQSPATLSLSPGERATLSCSASSSVSYMHWYQQKPGQAPRLLIYDTSKLASGIPARFSGSGSGTDFTLTISSLEPEDFAVYYCFQGSGYPYTFGQGTKLEIKRTVAAPSVFIFPPSDEQLKSGTASVVCLLNNFYFREAKVQWKVDNALQSGNSQESVTEQDSKDSTYSLSSTLTLSKADYEKHKVYACEVTHQGLSSPVTKSFNRGEC

SEQ ID NO: 4838 - protein, 107 aa, Artificial Sequence
  Description of Artificial Sequence: Synthetic light chain variable domain
ENVLTQSPAIMSASPGEKVTMTCSASSSVSYMHWYQQKSITSPKLWIYDTSKLASGVPGRFSGSGSGNSYSLTISSMEAEDVATYYCFQGSGYPYTFGGGTKLEIKR

SEQ ID NO: 4839 - protein, 213 aa, Artificial Sequence
  Description of Artificial Sequence: Synthetic light chain variable domain
EIVLTQSPATLSLSPGERATLSCSASSSVSYMHWYQQKPGQAPRLLIYDTSKLASGIPARFSGSGSGTDYTLTISSLEPEDFAVYYCFQGSGYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4840 - protein, 106 aa, Artificial Sequence
  Description of Artificial Sequence: Synthetic light chain variable domain
EIVLTQSPATLSLSPGERATLSCSASSSVSYMHWYQQKPGQAPRLLIYDTSKLASGIPARFSGSGSGTDYTLTISSLEPEDFAVYYCFQGSGYPYTFGQGTKLEIK

SEQ ID NO: 4841 - protein, 108 aa, Artificial Sequence
  Description of Artificial Sequence: Synthetic light chain variable domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPSTFGGGTKVEIKR

SEQ ID NO: 4842 - protein, 112 aa, Artificial Sequence
  Description of Artificial Sequence: Synthetic light chain variable domain
QASQSVLTQPPSVSAAPGQRVSISCSGSSSNIGNYHVSWYQHLPGRAPKLLIYDNSKRPSGIPDRFSGSKSGTSATLDITGLQTGDEGDYYCATWDTSLRWVFGTGTKVTVL

SEQ ID NO: 4843 - protein, 107 aa, Artificial Sequence [sequence omitted]

SEQ ID NO: 4844 - protein, 111 aa, Artificial Sequence
  Description of Artificial Sequence: Synthetic light chain variable domain
DIVLTQSPDSLSVSLGERATINCRASKSVDSYGNSFMHWYQQKPGQPPKLLIYLASNLESGVPDRFSGSGSGTDFTLTISSLQAEDVAVYYCQQNNEDPRTFGGGTKVEIK

SEQ ID NO: 4845 - protein, 109 aa, Artificial Sequence
  Description of Artificial Sequence: Synthetic light chain variable domain
DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGGINGTKLEIK

SEQ ID NO: 4846 - protein, 111 aa, Artificial Sequence; identical to SEQ ID NO: 4844
  Description of Artificial Sequence: Synthetic light chain variable domain

SEQ ID NO: 4847 - protein, 113 aa, Artificial Sequence
  Description of Artificial Sequence: Synthetic light chain variable domain
DIVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPRTFGGGTKVEIKR

SEQ ID NO: 4848 - protein, 113 aa, Artificial Sequence
  Description of Artificial Sequence: Synthetic light chain variable domain
DIVMTQSPLSLPVTPGQPASISCRSSQSITHSNGNTYLEWYLQKPGQSPQLLIYKVSNRDSGVPDRFSGSGSGTDFTLKISRVEAEDVGVYYCFQGSHVPRTFGGGTKVEIKR

SEQ ID NO: 4849 - protein, 113 aa, Artificial Sequence
  Description of Artificial Sequence: Synthetic light chain variable domain
DIVMTQSPLSLPVTPGEPASISCRSSQSITHSSGNTYLEWYLQKPGQSPQLLIYKVSNRASGVPDRFSGSGSGTDFTLKISRVEAEDVGVYYCFQGSHVPRTFGGGTKVEIKR

SEQ ID NO: 4850 - protein, 113 aa, Artificial Sequence
  Description of Artificial Sequence: Synthetic light chain variable domain
DIVMTQSPLSLPVTPGQPASISCRSSQSITHSSGQTYLEWYLQKPGQSPQLLIYKVSNRDSGVPDRFSGSGSGTDFTLKISRVEAEDVGVYYCFQGSHVPRTFGGGTKVEIKR

SEQ ID NO: 4851 - protein, 113 aa, Artificial Sequence
  Description of Artificial Sequence: Synthetic light chain variable domain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTFGGGTKLEIKR

SEQ ID NO: 4852 - protein, 108 aa, Artificial Sequence
  Description of Artificial Sequence: Synthetic light chain variable domain
DILLTQSPAILSVSPGERVSFSCRASQSIGTSIHWYQRRTNGSPRLLIKSASESISGIPSRFSGSGSGTDFTLSINSVESEDIADYYCQQSNSWPTTFGAGTKLELKR

SEQ ID NO: 4853 - protein, 112 aa, Artificial Sequence
  Description of Artificial Sequence: Synthetic light chain variable domain
DVVMTQTPLSLPVSLGDQASISCRSSQSLVHINGNTYLHWYLQKPGQSPKLLIYKVSNRFSGVPDRFSGSGSGTDFTLKISRVEAEDLGVYFCSQSTHVPWTFGGGTKLEIK

SEQ ID NO: 4854 - protein, 112 aa, Artificial Sequence
  Description of Artificial Sequence: Synthetic light chain variable domain
DVLMTQTPLSLPVSLGDQASISCRSSQSIVHSNGNTYLEWFLQKPGQSPKLLIYTVSNRFSGVPDRFSGSGSGTDFTLKISRVEAEDLGVYYCFQGSHVPPTFGGGTKLEIK

SEQ ID NO: 4855 - protein, 107 aa, Artificial Sequence
  Description of Artificial Sequence: Synthetic light chain variable domain
DIQMTQSPSSLSASLGERVSLTCRASQDIGSSLNWLQQEPDGTIKRLIYATSSLDSGVPKRFSGSRSGSDYSLTISSLESEDFVDYYCLQYASSPWTFGGGTKLEIK

SEQ ID NO: 4856 - protein, 111 aa, Artificial Sequence
  Description of Artificial Sequence: Synthetic light chain variable domain
DIVLTQSPTSLAVSLGQRATISCRASESVDKFGMSFLNWFQQKPGQPPKLLIFVASSQGSGVPARFSGSGSGTDFSLNIHPVEEDDTAMYFCQQSKDIPYTFGGGTKLEIK

SEQ ID NO: 4857 - protein, 111 aa, Artificial Sequence
  Description of Artificial Sequence: Synthetic light chain variable domain
DIVMTQSPDSLAVSLGERATINCRASESVDKFGMSFLNWYQQKPGQPPKLLIFVASSQGSGVPDRFSGSGSGTDFTLTISSLQAEDVAVYYCQQSKDIPYTFGQGTKVEIK

SEQ ID NO: 4858 - protein, 111 aa, Artificial Sequence
  Description of Artificial Sequence: Synthetic light chain variable domain
DIVMTQSPDSLAVSLGERATINCRASESVDKFGVSFLNWYQQKPGQPPKLLIFVASSQGSGVPDRFSGSGSGTDFTLTISSLQAEDVAVYYCQQSKDIPYTFGQGTKVEIK

SEQ ID NO: 4859 - protein, 111 aa, Artificial Sequence
  Description of Artificial Sequence: Synthetic light chain variable domain
DIVLTQSPASLAVSLGQRATISCRASESVDRYGISFMNWFQQKPGQSPKLLIYAASNQGSGVPARFSGSGSGTDFSLNIHPLEEDDAAMYFCQHSKEVPYTFGGGTKLEIK

SEQ ID NO: 4860 - protein, 111 aa, Artificial Sequence
  Description of Artificial Sequence: Synthetic light chain variable domain
DIQMTQSPSSLSASVGDRVTITCRASESVDRYGISFMNWFQQKPGKAPKLLIYAASNQGSGVPSRFSGSGSGTDFTLTISSLQPEDFATYYCQHSKEVPYTFGQGTKVEIK

SEQ ID NO: 4861 - protein, 107 aa, Artificial Sequence
  Description of Artificial Sequence: Synthetic light chain variable domain
DIQMNQSPSSLSASLGDTITITCHASQNINVWLSWYQQKAGNNPKLLIYAASKLHTGVPSRFTGSGSGTLFTLTISSLQPEDIATYYCQQGQSYPLTFGSGTNLELK

SEQ ID NO: 4862 - protein, 107 aa, Artificial Sequence
  Description of Artificial Sequence: Synthetic light chain variable domain
DIQMTQSPSSLSASVGDRVTITCHASQNINVWLSWYQQKPGKNPKLLIYAASKLHTGVPSRFSGSGSGTDFTLTISSLQPEDFATYYCQQGQSYPLTFGQGTKVEIK

SEQ ID NO: 4863 - protein, 107 aa, Artificial Sequence
  Description of Artificial Sequence: Synthetic light chain variable domain
DIQMNQSPSSLSASLGDTITITCHASQNIHVWLSWYQQKPGNIPKLLIYKASTLHTGVPSRFNGSGSGTGFTLTISSLQPEDIATYYCQQGQSSPLTFGAGTKLEVK

SEQ ID NO: 4864 - protein, 107 aa, Artificial Sequence
  Description of Artificial Sequence: Synthetic light chain variable domain
DIQMTQSPSSLSASVGDRVTITCHASQNIHVWLSWYQQKPGKAPKLLIYKASTLHTGVPSRFSGSGSGTDFTLTISSLQPEDFATYYCQQGQSSPLTFGQGTKVEIK

SEQ ID NO: 4865 - protein, 107 aa, Artificial Sequence
  Description of Artificial Sequence: Synthetic light chain variable domain
DIQMTQSPSSLSASVGDRVTITCRASQGIRNDLDWYQQKPGKAPKRLIYAASSLQSGVPSRFNGSGSGTEFTLTISSLQPEDFATYYCLQHDSYPLTFGGGTKVEIK

SEQ ID NO: 4866 - protein, 107 aa, Artificial Sequence
  Description of Artificial Sequence: Synthetic light chain variable domain
AIQMTQSPSSLSASVGDRVTITCRASQGIRNDLDWYQQKPGKAPKRLIYAASSLQSGVPSRFSGSGSGTDFTLTISSLQPEDFATYYCLQHSIYPPTFGQGTKVEIK

SEQ ID NO: 4867 - protein, 107 aa, Artificial Sequence
  Description of Artificial Sequence: Synthetic light chain variable domain
AIRITQSPSSLSASVGDRVTITCRASQGIRNDLDWYQQKPGKAPKRLIYAASSLQSGVPSRFSGSGSGTEFTLTISSLQPEDFATYYCLQHDSYPLTFGGGTKVEIK

SEQ ID NO: 4868 - protein, 111 aa, Artificial Sequence
  Description of Artificial Sequence: Synthetic light chain variable domain
EIVLTQSPATLSLSPGERATLSCRASESVAKYGLSLLNWFQQKPGQPPRLLIFAASNRGSGIPARFSGSGSGTDFTLTISSLEPEDFAVYYCQQSKEVPFTFGQGTKVEIK

SEQ ID NO: 4869 - protein, 111 aa, Artificial Sequence
  Description of Artificial Sequence: Synthetic light chain variable domain
DIVLTQSPGFLVVSLGQRATISCRASESVAKYGLSLLNWFQQKPGQPPKLLIFAASNRGSGVPARFSGSGSGTDFSLNIHPMEEDDTAMYFCQQSKEVPFTFGSGTKLEIK

SEQ ID NO: 4870 - protein, 119 aa, Artificial Sequence
  Description of Artificial Sequence: Synthetic light chain variable domain
EVQLVESGGGLVQPGGSLRLSCAASGFTFSSFSMSWVRQAPGKGLEWVATISGGKTFTDYVDAVKGRFTISRDNSKNTLYLQMNSLRAEDTAVYYCTRANYGNWFFEVWGQGTLVTVSS

SEQ ID NO: 4871 - protein, 108 aa, Artificial Sequence
  Description of Artificial Sequence: Synthetic light chain variable domain
EIVLTQSPGTLSLSPGERATLSCRASQSFSSSYLAWYQQKPGQAPRLLIYGASSRATGIPDRFSGSGSGTDFTLTISRLEPEDFAVYYCQQYDRSPLTFGGGTKVEIK

SEQ ID NO: 4872 - protein, 109 aa, Artificial Sequence
  Description of Artificial Sequence: Synthetic light chain variable domain
DIVLTQSPASLAVSPGQRATISCRASESVDNYGNTFMHWYQQKPGQPPKLLIYRASNLESGIPARFSGSDSRTDFTINPVEADDVATYYCQQSKEDPPTFGAGTKLELK

SEQ ID NO: 4873 - protein, 111 aa, Artificial Sequence
  Description of Artificial Sequence: Synthetic light chain variable domain
AIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELK

SEQ ID NO: 4874 - protein, 107 aa, Artificial Sequence
  Description of Artificial Sequence: Synthetic light chain variable domain
SIVMTQSPDSLAVSLGERATINCKASQSVTNDVAWYQQKPGQPPKLLIYYASNRYTGVPDRFSGSGYGTDFTLTISSLQAEDVAVYFCQQDYSSPYTFGQGTKVEIK

SEQ ID NO: 4875 - protein, 107 aa, Artificial Sequence
  Description of Artificial Sequence: Synthetic light chain variable domain
SIVMTQSPDSLAVSLGERATINCKASQSVTNDVAWYQQKPGQPPKLLIYYASNRYTGVPDRFSGSGYGTDFTFTISSLQAEDVATYFCQQDYSSPYTFGQGTKVEIK

SEQ ID NO: 4876 - protein, 107 aa, Artificial Sequence
  Description of Artificial Sequence: Synthetic light chain variable domain
DIVMTQSPDSLAVSLGERATINCKASQSVTNDVAWYQQKPGQPPKLLIYYASNRYTGVPDRFSGSGSGTDFTLTISSLQAEDVAVYYCQQDYSSPYTFGQGTKVEIK

SEQ ID NO: 4877 - protein, 107 aa, Artificial Sequence
  Description of Artificial Sequence: Synthetic light chain variable domain
SIVMTQSPDSLAVSLGERATINCKASQSVTNDVAWYQQKPGQPPKLLIYYASNRYTGVPDRFSGSGSGTDFTLTISSLQAEDVAVYFCQQDYSSPYTFGQGTKVEIK

SEQ ID NO: 4878 - protein, 111 aa, Artificial Sequence
  Description of Artificial Sequence: Synthetic light chain variable domain
QSVLTQPPSASGTPGQRVTISCSGSTSNIGTNTANWFQQLPGTAPKLLIHNNNQRPSGVPDRFSGSKSGTSASLAISGLQSEDEADYYCAAWDDSLNGHWVFGGGTKLTVL

SEQ ID NO: 4879 - protein, 109 aa, Artificial Sequence
  Description of Artificial Sequence: Synthetic light chain variable domain
EIVLTQSPVTLSLSPGERATLSCRASQSVSSYLAWYQQKPGQAPRLLIYDASNRATGIPARFSGSGSGTDFTLTISSLEPEDFAVYYCQQRSNWMYTFGQGTKLEIKRT

SEQ ID NO: 4880 - protein, 214 aa, Artificial Sequence
  Description of Artificial Sequence: Synthetic light chain variable domain
EIVLTQSPVTLSLSPGERATLSCRASQSVSSYLAWYQQKPGQAPRLLIYQASNRATGIPARFSGSGSGTDFTLTISSLEPEDFAVYYCQQRSNWMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4881 - protein, 109 aa, Artificial Sequence; identical to SEQ ID NO: 4879
  Description of Artificial Sequence: Synthetic light chain variable domain

SEQ ID NO: 4882 - protein, 127 aa, Artificial Sequence; identical to SEQ ID NO: 771
  Description of Artificial Sequence: Synthetic light chain variable domain

SEQ ID NO: 4883 - protein, 214 aa, Artificial Sequence
  Description of Artificial Sequence: Synthetic light chain variable domain
DIVMTQSQKFMSTSVGDRVSVTCKASQNVGTNVAWYQQKPGQSPKALIYSTSYRYSGVPDRFTGSGSGTDFTLTISNVQSEDLAEYFCQQYNSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4884 - protein, 125 aa, Artificial Sequence; identical to SEQ ID NO: 2374
  Description of Artificial Sequence: Synthetic light chain variable domain

SEQ ID NO: 4885 - protein, 107 aa, Artificial Sequence
  Description of Artificial Sequence: Synthetic light chain variable domain
DIQMTQSPSSLSASVGDRVTITCSSSQDISNYLNWYQQKPGKAPKLLIYYTSTLHLGVPSRFSGSGSGTDFTFTISSLEAEDAATYYCQQYYNLPWTFGQGTKVEIK

SEQ ID NO: 4886 - protein, 107 aa, Artificial Sequence
  Description of Artificial Sequence: Synthetic light chain variable domain
DIQMTQSPSSLSASVGDRVTITCSSSQDISNYLNWYQQKPGKAPKLLIYYTSTLHLGIPPRFSGSGYGTDFTLTINNIESEDAAYYFCQQYYNLPWTFGQGTKVEIK

SEQ ID NO: 4887 - protein, 107 aa, Artificial Sequence
  Description of Artificial Sequence: Synthetic light chain variable domain
EIVLTQSPATLPVTLGQPASISCSSSQDISNYLNWYQQKPGQAPRLLIYYTSTLHLGVPSRFSGSGSGTDFTFTISSLEAEDAATYYCQQYYNLPWTFGQGTKVEIK

SEQ ID NO: 4888 - protein, 107 aa, Artificial Sequence
  Description of Artificial Sequence: Synthetic light chain variable domain
DIQMTQSPSSLSASVGDRVTITCSSSQDISNYLNWYLQKPGQSPQLLIYYTSTLHLGIPDRFSGSGSGTDFTLTISRLEPEDFAVYYCQQYYNLPWTFGQGTKVEIK

SEQ ID NO: 4889 - protein, 107 aa, Artificial Sequence
  Description of Artificial Sequence: Synthetic light chain variable domain
EIVLTQSPATLSLSPGERATLSCSSSQDISNYLNWYQQKPGKAPKLLIYYTSTLHLGVPSRFSGSGSGTDFTFTISSLEAEDAATYYCQQYYNLPWTFGQGTKVEIK

SEQ ID NO: 4890 - protein, 107 aa, Artificial Sequence
  Description of Artificial Sequence: Synthetic light chain variable domain
DIVMTQTPLSLPVTPGEPASISCSSSQDISNYLNWYQQKPGQAPRLLIYYTSTLHLGVPSRFSGSGSGTEFTLTISSLQPDDFATYYCQQYYNLPWTFGQGTKVEIK

SEQ ID NO: 4891 - protein, 107 aa, Artificial Sequence
  Description of Artificial Sequence: Synthetic light chain variable domain
DIQMTQSPSSLSASVGDRVTITCSSSQDISNYLNWYLQKPGQSPQLLIYYTSTLHLGVPSRFSGSGSGTEFTLTISSLQPDDFATYYCQQYYNLPWTFGQGTKVEIK

SEQ ID NO: 4892 - protein, 107 aa, Artificial Sequence
  Description of Artificial Sequence: Synthetic light chain variable domain
EIVLTQSPDFQSVTPKEKVTITCSSSQDISNYLNWYQQKPGQAPRLLIYYTSTLHLGVPSRFSGSGSGTDFTLTISSLQPEDFATYYCQQYYNLPWTFGQGTKVEIK

SEQ ID NO: 4893 - protein, 107 aa, Artificial Sequence
  Description of Artificial Sequence: Synthetic light chain variable domain
DIQMTQSPSSLSASVGDRVTITCSSSQDISNYLNWYQQKPGKAPKLLIYYTSTLHLGVPSRFSGSGSGTDFTFTISSLQPEDIATYYCQQYYNLPWTFGQGTKVEIK

SEQ ID NO: 4894 - protein, 107 aa, Artificial Sequence
  Description of Artificial Sequence: Synthetic light chain variable domain
AIQLTQSPSSLSASVGDRVTITCSSSQDISNYLNWYQQKPGQAPRLLIYYTSTLHLGVPSRFSGSGSGTDFTLTISSLQPEDFATYYCQQYYNLPWTFGQGTKVEIK

SEQ ID NO: 4895 - protein, 107 aa, Artificial Sequence
  Description of Artificial Sequence: Synthetic light chain variable domain
EIVLTQSPDFQSVTPKEKVTITCSSSQDISNYLNWYQQKPGQAPRLLIYYTSTLHLGVPSRFSGSGSGTDFTFTISSLEAEDAATYYCQQYYNLPWTFGQGTKVEIK

SEQ ID NO: 4896 - protein, 107 aa, Artificial Sequence
  Description of Artificial Sequence: Synthetic light chain variable domain
DIVMTQTPLSLPVTPGEPASISCSSSQDISNYLNWYQQKPGQAPRLLIYYTSTLHLGIPDRFSGSGSGTDFTLTISRLEPEDFAVYYCQQYYNLPWTFGQGTKVEIK

SEQ ID NO: 4897 - protein, 451 aa, Artificial Sequence
  Description of Artificial Sequence: Synthetic light chain variable domain
QVQLVQSGAEVKKPGASVKVSCKASGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 4898 - protein, 214 aa, Artificial Sequence
  Description of Artificial Sequence: Synthetic light chain variable domain
DIQMTQSPSSLSASVGDRVTITCSSSQDISNYLNWYQQKPGKAPKLLIYYTSTLHLGVPSRFSGSGSGTDFTFTISSLEAEDAATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4899 - protein, 214 aa, Artificial Sequence
  Description of Artificial Sequence: Synthetic light chain variable domain
DIQMTQSPSSLSASVGDRVTITCSSSQDISNYLNWYQQKPGKAPKLLIYYTSTLHLGIPPRFSGSGYGTDFTLTINNIESEDAAYYFCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4900 - protein, 214 aa, Artificial Sequence
  Description of Artificial Sequence: Synthetic light chain variable domain
EIVLTQSPATLPVTLGQPASISCSSSQDISNYLNWYQQKPGQAPRLLIYYTSTLHLGVPSRFSGSGSGTDFTFTISSLEAEDAATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4901 - protein, 214 aa, Artificial Sequence
  Description of Artificial Sequence: Synthetic light chain variable domain
DIQMTQSPSSLSASVGDRVTITCSSSQDISNYLNWYLQKPGQSPQLLIYYTSTLHLGIPDRFSGSGSGTDFTLTISRLEPEDFAVYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4902 - protein, 214 aa, Artificial Sequence
  Description of Artificial Sequence: Synthetic light chain variable domain
EIVLTQSPATLSLSPGERATLSCSSSQDISNYLNWYQQKPGKAPKLLIYYTSTLHLGVPSRFSGSGSGTDFTFTISSLEAEDAATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4903 - protein, 214 aa, Artificial Sequence
  Description of Artificial Sequence: Synthetic light chain variable domain
DIVMTQTPLSLPVTPGEPASISCSSSQDISNYLNWYQQKPGQAPRLLIYYTSTLHLGVPSRFSGSGSGTEFTLTISSLQPDDFATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4904 - protein, 214 aa, Artificial Sequence
  Description of Artificial Sequence: Synthetic light chain variable domain
DIQMTQSPSSLSASVGDRVTITCSSSQDISNYLNWYLQKPGQSPQLLIYYTSTLHLGVPSRFSGSGSGTEFTLTISSLQPDDFATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4905 - protein, 214 aa, Artificial Sequence
  Description of Artificial Sequence: Synthetic light chain variable domain
EIVLTQSPDFQSVTPKEKVTITCSSSQDISNYLNWYQQKPGQAPRLLIYYTSTLHLGVPSRFSGSGSGTDFTLTISSLQPEDFATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4906 - protein, 214 aa, Artificial Sequence
  Description of Artificial Sequence: Synthetic light chain variable domain
DIQMTQSPSSLSASVGDRVTITCSSSQDISNYLNWYQQKPGKAPKLLIYYTSTLHLGVPSRFSGSGSGTDFTFTISSLQPEDIATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4907 - protein, 214 aa, Artificial Sequence
  Description of Artificial Sequence: Synthetic light chain variable domain
AIQLTQSPSSLSASVGDRVTITCSSSQDISNYLNWYQQKPGQAPRLLIYYTSTLHLGVPSRFSGSGSGTDFTLTISSLQPEDFATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4908 - protein, 214 aa, Artificial Sequence
  Description of Artificial Sequence: Synthetic light chain variable domain
EIVLTQSPDFQSVTPKEKVTITCSSSQDISNYLNWYQQKPGQAPRLLIYYTSTLHLGVPSRFSGSGSGTDFTFTISSLEAEDAATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4909 - protein, 214 aa, Artificial Sequence
  Description of Artificial Sequence: Synthetic light chain variable domain
DIVMTQTPLSLPVTPGEPASISCSSSQDISNYLNWYQQKPGQAPRLLIYYTSTLHLGIPDRFSGSGSGTDFTLTISRLEPEDFAVYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4910 - protein, 214 aa, Artificial Sequence
  Description of Artificial Sequence: Synthetic light chain variable domain
EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4911 - protein, 108 aa, Artificial Sequence
  Description of Artificial Sequence: Synthetic light chain variable domain
DIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 4912 - protein, 106 aa, Artificial Sequence
  Description of Artificial Sequence: Synthetic light chain variable domain
DIQMTQSPPVLSASVGDRVTLSCKASQNINKNLDWYQQKHGEAPRLLIYYTNNLQTGIPSRFSGSGSGTDYTLTISSLQPEDVATYFCYQYKSGNTFGAGTKLELK

SEQ ID NO: 4913 - protein, 106 aa, Artificial Sequence
  Description of Artificial Sequence: Synthetic light chain variable domain
EIVMTQSPATLSVSPGERATLSCKASQNINKNLDWYQQKPGQAPRLLIYYTNNLQTGIPARFSGSGSGTEFTLTISSLQSEDFAVYYCYQYKSGNTFGQGTKLEIK

SEQ ID NO: 4914 - protein, 106 aa, Artificial Sequence
  Description of Artificial Sequence: Synthetic light chain variable domain
DIQMTQSPPVLSASVGDRVTLSCKASQNINKNLDWYHQKHGEAPKLLIYYTNNLQTGIPSRFSGSGSGTDYTLIISSLQPEDVATYYCYQYNSGPTFGTGTKLELK

SEQ ID NO: 4915 - protein, 112 aa, Artificial Sequence
  Description of Artificial Sequence: Synthetic light chain variable domain
DIVMTQSPDSLAVSLGERATINCRASESVDNYGNSFMHWYQQKPGQPPKLLIYLASNLESGVPDRFSGSGSGTDFTLTISSLQAEDVAVYYCQQNYEDPFTFGQGTKVEIKR

SEQ ID NO: 4916 - protein, 112 aa, Artificial Sequence
  Description of Artificial Sequence: Synthetic light chain variable domain
DIVMTQSPDSLAVSLGERATINCRASESVDNYGNSFMHWYQQKPGQPPKLLIYLASNLESGVPDRFSGSGSRTDFTLTISSLQAEDVAVYYCQQNYEDPFTFGQGTKVEIKR

SEQ ID NO: 4917 - protein, 113 aa, Artificial Sequence
  Description of Artificial Sequence: Synthetic light chain variable domain
DVVMTQTPLSLPVSLGDQASISCRSSQSLVHSNGNTYLQWYLQKPGQSPKLLIYKVSNRFSGVPDRFSGSGSGTDFTLKISRVEAEDLGIYFCSQSTHFPYTFGGGTKLEIKR

SEQ ID NO: 4918 - protein, 114 aa, Artificial Sequence
  Description of Artificial Sequence: Synthetic light chain variable domain
DIVMTQSPSSLTVTAGEKVTMSCKSSQSLLNSGNQKNYLTWFQQKPGQPPKLLIYWASTRESGVPDRFTGSGSGTDFTLTISNVQAEDLAVYYCQNDYSFPFTFGQGTKVEIKR

SEQ ID NO: 4919 - protein, 108 aa, Artificial Sequence
  Description of Artificial Sequence: Synthetic light chain variable domain
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 4920 - protein, 112 aa, Artificial Sequence
  Description of Artificial Sequence: Synthetic light chain variable domain
NIVLTQSPASLAVSLGQRATISCRASESVDNYGNSFMHWYQQKPGQPPKLLIYLASNLESGVPARFSGSGSRTDFTLTIDPVEADDAATYYCQQNYEDPFTFGSGTKVEIKR

SEQ ID NO: 4921 - protein, 107 aa, Artificial Sequence
  Description of Artificial Sequence: Synthetic light chain variable domain
DIQMTQSPSSLSASVGDRVTITCSASQDINNYLNWYQQKPGKAPKLLIYYTSSLHSGVPSRFSGSGSGTDFTLTISSLQPEDFATYYCQQFSNLPWTFGGGTKLEIK

SEQ ID NO: 4922 - protein, 213 aa, Artificial Sequence
  Description of Artificial Sequence: Synthetic light chain variable domain
DIQMTQTTSSLSASLGDRVTISCSASQDINNYLNWYQQKPDGTVKLLIYYTSSLHSGVPSRFSGSGSGTDYSLTISNLEPEDFATYYCQQFSNLPWTFGGGTKLEIKRADAAPTVSIFPPSSEQLTSGGASWCFLNNFYPKDINVKWKIDGSERQNGVLNSWTDQDSKDSTYSMSSTLTLTKDEYERHNSYTCEATHKTSTSPIVKSFNRNEC

SEQ ID NO: 4923 - protein, 110 aa, Artificial Sequence
  Description of Artificial Sequence: Synthetic light chain variable domain
DIQMTQTTSSLSASLGDRVTISCSASQDINNYLNWYQQKPDGTVKLLIYYTSSLHSGVPSRFSGSGSGTDYSLTISNLEPEDFATYYCQQFSNLPWTFGGGTKLEIKRAD

SEQ ID NO: 4924 - protein, 107 aa, Artificial Sequence
  Description of Artificial Sequence: Synthetic light chain variable domain
DIVMTQSQKFMSTSVGDRVSVTCKASQNVGINVAWYQQKPGQSPKSLISSASYRYSGVPDRFTGSGSGTDFTLTITNNQSEDLAEYFCQQYDTYPFTFGSGTKLEIK

SEQ ID NO: 4925 - protein, 445 aa, Artificial Sequence; identical to SEQ ID NO: 2417
  Description of Artificial Sequence: Synthetic light chain variable domain

SEQ ID NO: 4926 - protein, 107 aa, Artificial Sequence
  Description of Artificial Sequence: Synthetic light chain variable domain
DIQMTQSPSSLSASVGDRVTITCKASQNVGINVAWYQQKPGKAPKSLISSASYRYSGVPSRFTGSGSGTDFTLTISSLQPEDFATYFCQQYDTYPFTFGQGTKVEIK

SEQ ID NO: 4927 - protein, 107 aa, Artificial Sequence
  Description of Artificial Sequence: Synthetic light chain variable domain
DIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGQGTKVEIK

SEQ ID NO: 4928 - protein, 107 aa, Artificial Sequence
  Description of Artificial Sequence: Synthetic light chain variable domain
DIQMTQSPSSLSASVGDRVTITCKASQNVGINVAWFQQKPGKAPKSLISSASYRYSGVPSRFSGSGSGTDFTLTISSLQPEDFATYYCQQYDTYPFTFGQGTKVEIK

SEQ ID NO: 4929 - protein, 132 aa, Artificial Sequence
  Description of Artificial Sequence: Synthetic light chain variable domain
MRCLAEFLGLLVLWIPGAIGDIVMTQAAPSVSVTPGESVSISCRSSKSLLHSNGNTYLYWFLQRPGQSPQFLIYRMSNLASGVPDRFSGSGSGTAFTLRISRVEAEDVGVYYCMQHLEYPYTFGGGTKLEIK

SEQ ID NO: 4930 - protein, 239 aa, Artificial Sequence
  Description of Artificial Sequence: Synthetic light chain variable domain
MRVPAQLLGLLLLWLPGARCDIVMTQTPLSLSVTPGQPASISCRSSKSLLHSNGNTYLYWFLQKPGQSPQFLIYRMSNLASGVPDRFSGSGSGTDFTLKISRVEAEDVGVYYCMQHLEYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4931 - protein, 106 aa, Artificial Sequence
  Description of Artificial Sequence: Synthetic light chain variable domain
DIQVTQSPSLLSASVGDRVTLNCKGSQNIYKSLAWFRLKRGEAPKLLIYDANSLQTGIPSRFSGSGSGTDFTLTITSLQPEDVATYFCQQYYSGYTFGAGTKLELK

SEQ ID NO: 4932 - protein, 106 aa, Artificial Sequence
  Description of Artificial Sequence: Synthetic light chain variable domain
DIQMTQSPSSLSASVGDRVTITCKGSQNIYKSLAWFQQKPGKVPKLLIYDANSLQTGIPSRFSGSGSGTDFTLTISSLQPEDVATYYCQQYYSGYTFGGGTKVEIK

SEQ ID NO: 4933 - protein, 106 aa, Artificial Sequence
  Description of Artificial Sequence: Synthetic light chain variable domain
DIQMTQSPSSLSASVGDRVTITCKGSQNIYKSLAWFQLKPGKVPKLLIYDANSLQTGIPSRFSGSGSGTDFTLTISSLQPEDVATYYCQQYYSGYTFGGGTKVEIK

SEQ ID NO: 4934 - protein, 106 aa, Artificial Sequence
  Description of Artificial Sequence: Synthetic light chain variable domain
DIQMTQSPSSLSASVGDRVTINCKGSQNIYKSLAWFQQKPGKVPKLLIYDANSLQTGIPSRFSGSGSGTDFTLTISSLQPEDVATYYCQQYYSGYTFGGGTKVEIK

SEQ ID NO: 4935 - protein, 106 aa, Artificial Sequence
  Description of Artificial Sequence: Synthetic light chain variable domain
DIQMTQSPSSLSASVGDRVTITCKASQNIYNSLAWYQQKPGKAPKVLIFNANSLQTGIPSRFSGSGSGTDFTLTISSLQPEDFATYYCQQFYSGYTFGQGTKLEIK

SEQ ID NO: 4936 - protein, 106 aa, Artificial Sequence
  Description of Artificial Sequence: Synthetic light chain variable domain
DIQMTQSPSSLSASVGDRVTITCKASQNIYNSLAWYQQKPGKAPKVLIFNANSLQTGVPSRFSGSGSGTDFTLTISSLQPEDFATYYCQQFYSGYTFGQGTKLEIK

SEQ ID NO: 4937 - protein, 106 aa, Artificial Sequence
  Description of Artificial Sequence: Synthetic light chain variable domain
DIQMTQSPSSLSASVGDRVTINCKASQNIYNSLAWYQQKPGKAPKVLIFNANSLQTGIPSRFSGSGSGTDFTLTISSLQPEDFATYYCQQFYSGYTFGQGTKLEIK

SEQ ID NO: 4938 - protein, 111 aa, Artificial Sequence
  Description of Artificial Sequence: Synthetic light chain variable domain
DIVLTQSPASLAVSLGQRATISCRASKSVSTSGYSYMYWYQQKPGQPPKLLIYLASNLESGVPARFSGSGSGTDFTLNIHPVEEEDAATYYCQHSRELPFTFGSGTKLEIK

SEQ ID NO: 4939 - protein, 112 aa, Artificial Sequence
  Description of Artificial Sequence: Synthetic light chain variable domain
DIVMSQSPSSLAVSAGEKVTMSCKSSQSLLNSSTRKNFLAWYQQKPGQSPKLLIYWASTRESGVPDRFTGSGSGTDFTLTISSVQAEDLAVYYCKQSYNRYTFGGGTKLEIK

SEQ ID NO: 4940 - protein, 107 aa, Artificial Sequence
  Description of Artificial Sequence: Synthetic light chain variable domain
DIVMTQSPATLSVTPGDRVSLSCRASQSISDYLHWYQQKSHESPRLLIKYASQSISGIPSRFSGSGSGSDFTLSINSVEPEDVGVYYCQNGHNFPRTFGGGTKLEIK

SEQ ID NO: 4941 - protein, 112 aa, Artificial Sequence
  Description of Artificial Sequence: Synthetic light chain variable domain
DIVMSQSPSSLAVSAGEKVTMNCKSSRSLLNSRIRKNYLAWYQQKPGQSPKLLIYWASTRESGVPDRFTGSGSGTDFTLTISSVQAEDLAVYYCKQSYNLLTFGAGTKLELK

SEQ ID NO: 4942 - protein, 106 aa, Artificial Sequence
  Description of Artificial Sequence: Synthetic light chain variable domain
DIRMTQSPSLLSASVGDRVTLNCKASQNIYNSLAWYQQKLGEGPKVLIFNANSLQTGIPSRFSGSGSGTDFTLTISSLQPEDFATYFCQQFYSGYTFGAGTKLELK

SEQ ID NO: 4943 - protein, 106 aa, Artificial Sequence
  Description of Artificial Sequence: Synthetic light chain variable domain
DIQVTQSPSLLSASVGDRVTLNCKASQNIYNSLAWYQQKLGEGPKVLIFNANSLQTGIPSRFSGSGSGTDFTLTISSLQPEDFATYFCQQFYSGYTFGAGTKLELK

SEQ ID NO: 4944 - protein, 106 aa, Artificial Sequence
  Description of Artificial Sequence: Synthetic light chain variable domain
DIVLTQSPSLLSASVGDRVTLNCKASQNIYNSLAWYQQKLGEGPKVLIFNANSLQTGIPSRFSGSGSGTDFTLTISSLQPEDFATYFCQQFYSGYTFGAGTKLELK

SEQ ID NO: 4945 - protein, 234 aa, Artificial Sequence
  Description of Artificial Sequence: Synthetic light chain variable domain
MRVPAQLLGLLLLWLRGARCDIQMTQSPSSLSASVGDRVTITCRPSQDISSYLNWYQQKPGKAPKLLIYAASSLQSGVPLRFSGSGSGTDFTLTISSLQPEDFATYYCQQSYSTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4946 - protein, 235 aa, Artificial Sequence
  Description of Artificial Sequence: Synthetic light chain variable domain
METPAQLLFLLLLWLPDTTGEFVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4947 - protein, 236 aa, Artificial Sequence
  Description of Artificial Sequence: Synthetic light chain variable domain
MDMRVPAQLLGLLLLWLRGARCDIQMTQSPSSLSASVGDRVTITCRASQSISGFLIWYQQKPGKAPKLLIYATSSLQSGVPSRFSGSGSGTDFTLTISSLQPEDFATYYCQQSYSTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4948 - protein, 223 aa, Artificial Sequence
  Description of Artificial Sequence: Synthetic light chain variable domain
METPAQLLFLLLLWLPDTTGEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDTYSLSSTLTLSKKHKVYACEVTHQPVTKSFNRGEC

SEQ ID NO: 4949 - protein, 236 aa, Artificial Sequence
  Description of Artificial Sequence: Synthetic light chain variable domain
MDMRVPAQLLGLLLLWLRGARCDIQMTQSPSSLSASVGDRVTITCRPSQIISSLLNWYQQKPGKAPKLLIHAASSLQSGVPSRFSGSGSGTDFTLTISSLQPEDFATYYCQQSYSTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4950 - protein, 236 aa, Artificial Sequence
  Description of Artificial Sequence: Synthetic light chain variable domain
MDMRVPAQLLGLLLLWLRGARCDIQMTQSPSSLSASVGDRVTITCRASQSISGFLIWYQQRPGKAPKLLIYATSSLQSGVPSRFSGSGSGTDFTLTISSLQPEDFATYYCQQSYSTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4951 - protein, 234 aa, Artificial Sequence
  Description of Artificial Sequence: Synthetic light chain variable domain
MRVPAQLLGLLLLWLRGARCDIQMTQSPSSLSASVGDRVTITCRASQSISGFLNWYQQKPGKAPKLLIYATSSLQSGVPFRFSGSGSGTDFTLTISSLQPEDFATYYCQQSYSVPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4952 - protein, 235 aa, Artificial Sequence
  Description of Artificial Sequence: Synthetic light chain variable domain
METPAQLLFLLLLWLPDTTGEFVLTQSPGTLSLSPGERATLSCRASQSVSSSYLAWYQQKPGQAPRLLIYGASSRATGIPDRFSGSGSGTDFTLTISRLEPEDFVVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4953 - protein, 235 aa, Artificial Sequence
  Description of Artificial Sequence: Synthetic light chain variable domain
DMRVPAQLLGLLLLWLRGARCDIQMTQSPSSLSASVGDRVTITCRASQSISGFLIWYQQRPGKAPKLLIYATSSLQSGVPLRFSGSESGTDFTLTISSLQPEDFATYYCQQSYSTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4954 - protein, 236 aa, Artificial Sequence
  Description of Artificial Sequence: Synthetic light chain variable domain
MDMRVPAQLLGLLLLWLRGARCDIQMTQSPSSLSASVGDRVTITCRPSQIISSLLNWYQQKPGKAPKLLIYAASSLQSGVPSRFSGSGSGTDFTLTISSLQPEDFATYYCQQSYSTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4955 - protein, 466 aa, Artificial Sequence; identical to SEQ ID NO: 2447
  Description of Artificial Sequence: Synthetic light chain variable domain

SEQ ID NO: 4956 - protein, 218 aa, Artificial Sequence
  Description of Artificial Sequence: Synthetic light chain variable domain
DTTGEIVMTQSPATLSVSPGERATLSCRASQSVSSNLAWYQQKPGQAPRLLIYGASTRASGIPDRISGSGSGTEFTLIISSLQSEDFAVYYCQQSNNWPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4957 - protein, 236 aa, Artificial Sequence
  Description of Artificial Sequence: Synthetic light chain variable domain
MDMRVPAQLLGLLLLWFPGSRCDIQMTQSPSSVSASVGDRVTISCRASQDISGWLAWYQQKPGKAPKLLISATSSLHSGVPSRFSGSGSGTDFTLTISSLQPEDFATYYCQQTNSFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4958 - protein, 236 aa, Artificial Sequence
  Description of Artificial Sequence: Synthetic light chain variable domain
MDMRVPAQLLGLLLLWFPGSRCDIQMTQSPSSVSASVGDRVTITCRASQDISSWLAWYQRKPGKAPKLQIYAASSLESGVPSRFNGSGSGTDFTLSISSLQPEDFATYYCQQTNSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4959 - protein, 240 aa, Artificial Sequence
  Description of Artificial Sequence: Synthetic light chain variable domain
MVLQTQVFISLLLWISGAYGDIVMTQSPDSLAVSLGERATINCKSSQSILFFSNNKNYLAWYRQKPGQPPNLLIYWASTRESGVPDRFSGSGSGTDFTLTISSLQAEDVAVYYCQQYYSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4960 - protein, 213 aa, Artificial Sequence
  Description of Artificial Sequence: Synthetic light chain variable domain
DIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 4961 - protein, 206 aa, Artificial Sequence
  Description of Artificial Sequence: Synthetic light chain variable domain
RHQTQSPSSLSASVGDRTITCRASQSISSYLWYQQKPGAPKLLIYAASSLQSGVPSGFSGSGSGTDFTLTISSLQPEDFATYYCQQSYSTPLTFGGGTVEIKRTVAAPSVFIFPPSDEQLKSGTASWCLLNNFYPREAKVQKVDNALQSGNSQESVTEQDSDSTYSLSSTLTLSKADYEKHKVYACEVTHQGLSSPVTKSFNRGEC

SEQ ID NO: 4962 - protein, 106 aa, Artificial Sequence
  Description of Artificial Sequence: Synthetic light chain variable domain
DIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIK

SEQ ID NO: 4963 - protein, 109 aa, Artificial Sequence
  Description of Artificial Sequence: Synthetic light chain variable domain
AYDMTQTPASVSAAVGGTVTIKCQASQSISNYLAWYQQKPGQPPKLLIYQASTLAPGVSSRFKGSGSGTEFTLTISGVECADAATYYCQQGYTSSNVENVFGGGTGVVV

(The sequence listing continues in the following parts.)

The invention claimed is:

1. A composition comprising an effector module, said effector module comprising a stimulus response element (SRE) and at least one payload which is operably linked to said SRE, wherein the SRE comprises a destabilizing domain (DD), said DD comprising, in whole or in part, a cGMP-specific 3',5'-cyclic phosphodiesterase (hPDE5; SEQ ID NO: 1) which is capable of ligand binding, and further comprising a mutation in the amino acid at position 732 (R732) of SEQ ID NO: 1.

2. A composition comprising an effector module, said effector module comprising a stimulus response element (SRE) and at least one payload which is operably linked to said SRE, wherein the SRE comprises a destabilizing domain (DD), wherein the DD comprises the catalytic domain of hPDE5 (SEQ ID NO: 3) which is capable of ligand binding, and comprises a mutation in the amino acid at the position corresponding to amino acid 732 (R732) of SEQ ID NO: 1.

3. The composition of claim 2, wherein the mutation in the amino acid at position 732 (R732) is selected from the group consisting of R732L, R732A, R732G, R732V, R732I, R732P, R732F, R732W, R732Y, R732H, R732S, R732T, R732D, R732E, R732Q, R732N, R732M, R732C, and R732K.

4. The composition of claim 3, wherein the mutation in the amino acid at position R732 is R732L.

5. The composition of claim 2, wherein the DD further comprises a mutation in the amino acid at the position corresponding to amino acid 764 (D764) of SEQ ID NO: 1, wherein the mutation at D764 is selected from the group consisting of D764N and D764A.

6. The composition of claim 2, wherein the DD further comprises a mutation in the amino acid at the position corresponding to amino acid 612 (Y612) of SEQ ID NO: 1, wherein the mutation at Y612 is selected from the group consisting of Y612A, Y612F, and Y612W.

7. The composition of claim 2, wherein the DD further comprises an F736A mutation in the amino acid at the position corresponding to amino acid 736 (F736) of SEQ ID NO: 1.

8. The composition of claim 2, wherein the DD further comprises an H653A mutation in the amino acid at the position corresponding to amino acid 653 (H653) of SEQ ID NO: 1.

9. The composition of claim 2, wherein the at least one payload is an immunotherapeutic agent.

10. The composition of claim 9, wherein the immunotherapeutic agent is selected from a chimeric antigen receptor (CAR) and a cytokine-cytokine receptor fusion polypeptide.

11. The composition of claim 10, wherein the immunotherapeutic agent is a chimeric antigen receptor (CAR) that comprises:
 (a) an extracellular target moiety;
 (b) a transmembrane domain;
 (c) an intracellular signaling domain; and
 (d) optionally, one or more co-stimulatory domains.

12. The composition of claim 11, wherein the extracellular target moiety is a scFv derived from an antibody that specifically recognizes a CD19 target molecule.

13. The composition of claim 10, wherein the immunotherapeutic agent is a cytokine-cytokine receptor fusion polypeptide that comprises the whole or a portion of IL15, fused to the whole or a portion of IL15Ra to produce a IL15-IL15Ra fusion polypeptide.

14. The composition of claim 2, wherein the SRE is responsive to one or more stimuli, and wherein said one or more stimuli is selected from Tadalafil, Vardenafil, Sildenafil, Avanafil, Lodenafil, Mirodenafil, Udenafil, Benzamidenafil, Dasantafil, and Beminafil.

15. A pharmaceutical composition comprising the composition of claim 2 and a pharmaceutically acceptable excipient.

16. A polynucleotide encoding the composition of claim 2.

17. A pharmaceutical composition comprising the polynucleotide of claim 16 and a pharmaceutically acceptable excipient.

18. A vector comprising the polynucleotide of claim 16.

19. A cell comprising the polynucleotide of claim 16.

20. The cell of claim 19, wherein said cell is an immune cell for adoptive cell transfer (ACT), and optionally wherein the immune cell is a $CD8^+$ T cell, a $CD4^+$ T cell, a memory T cell, a terminally differentiated effector T cell, a natural killer (NK) cell, a NK T cell, a tumor infiltrating lymphocyte (TIL), a cytotoxic T lymphocyte (CTL), a regulatory T cell (Treg), or a dendritic cell (DC).

21. A pharmaceutical composition comprising the cell of claim 19 and a pharmaceutically acceptable excipient.

22. A method of producing a modified cell, said method comprising introducing into a cell a nucleic acid molecule comprising the polynucleotide of claim 16.

23. A method of modulating expression, function, and/or level of a payload in the cell of claim 19, said method comprising:
 administering to the cell a stimulus,
 wherein the SRE is responsive to the stimulus and wherein the expression, function, and/or level of the payload is modulated in response to the stimulus.

24. A method of inducing an immune response in the immune cell of claim 20, wherein the payload is an immunotherapeutic agent, said method comprising:
 administering to the cell a therapeutically effective amount of a stimulus to modulate the expression of the immunotherapeutic agent, wherein the immunotherapeutic agent is capable of inducing an immune response in the cell in response to the stimulus.

25. A method of reducing a tumor burden in a subject, comprising:
 (a) administering to the subject a therapeutically effective amount of the immune cells of claim 20; and
 (b) administering to the subject a therapeutically effective amount of a stimulus, wherein the stimulus is a ligand, to modulate the expression of the immunotherapeutic agent, thereby reducing the tumor burden.

26. A method of treating a disease in a subject in need thereof, said method comprising:
 (a) administering to the subject a therapeutically effective amount of the cell of claim 19, wherein the cell comprises a payload that treats the disease; and
 (b) administering to the subject a therapeutically effective amount of a stimulus,
 wherein the SRE is responsive to the stimulus and wherein expression of the payload is modulated in response to the stimulus to thereby treat the disease.

* * * * *

UNITED STATES PATENT AND TRADEMARK OFFICE
CERTIFICATE OF CORRECTION

PATENT NO. : 11,241,485 B2
APPLICATION NO. : 16/621593
DATED : February 8, 2022
INVENTOR(S) : Vipin Suri et al.

It is certified that error appears in the above-identified patent and that said Letters Patent is hereby corrected as shown below:

In the Specification

In Column 23, Line 24, delete "1821A," and insert -- I821A, --.

In Column 119, Line 45, delete "forper" and insert -- for per --.

In Column 401, Line 18, delete "117B," and insert -- IL17B, --.

In Column 413, Line 51, delete "L18" and insert -- IL18 --.

In Column 414, Line 49, delete "L 18" and insert -- IL18 --.

In Column 465, Line 64, delete "EL15)" and insert -- IL15) --.

In Column 467, Line 21, delete "CD1 b," and insert -- CD11b, --.

In Column 493, Line 8, delete "CD1 b," and insert -- CD11b, --.

In Column 504, Line 8, delete "a" and insert -- α --.

In Column 508, Line 1, delete "10M" and insert -- 10μM --.

In Column 522, Line 16, delete "g/ml)" and insert -- μg/ml) --.

In Column 539, Line 30, delete "0.5×10A6" and insert -- 0.5×10^6 --.

In Column 539, Line 50, delete "0.5×10A6" and insert -- 0.5×10^6 --.

Signed and Sealed this
Twenty-ninth Day of November, 2022

Katherine Kelly Vidal
*Director of the United States Patent and Trademark Office*